United States Patent 11,098,302 (IDENTIFICATION OF POLYNUCLEOTIDES ASSOCIATED WITH A SAMPLE) - sequence listing, part 2

SEQ ID NO: 2842 - DNA, 649 bp, Homo sapiens
  misc_feature: GYAE6OF02FWAVF.26.21.B10.1.454.CMB.1.raw
  modified_base (247)..(247): a, c, t, g, unknown or other
  misc_feature (247)..(247): n is a, c, g, or t
  modified_base (394)..(394): a, c, t, g, unknown or other
  misc_feature (394)..(394): n is a, c, g, or t
tcagagactatactcacgaccggtgctcgatttagtgtcgtcgcaagaggagaggggggggcctccaggaagcagcatcggaggtgcctcagccatggcatggatccctctcttcctcggcgtccttgcgttactgcacaggatccggtggtccttcggatgagctgacttccagcccaccctcagtcgtccgtcgtccccaggacagaccagccaccatcacctgcctcggcagacaagttggganatagaatgctgcctggtattaccagagccaggcacgtcccctatttcggctatcttaccaagataaggaagccggtccctagagggtacctcccgtagaaccggtaactttcgtacggtccttacccaacgttctaggggaaaaccncgtacgcccaactcctagacccaatccgacgccgggaccccagaccctacggagtcggacggtagacctacgtagttcgacgaggccggtagggaacaagtaccttaagtggttaagtggtttacgggcggtaacggggaccagggtccgttcgaacccggttcgtacgggtccgaacgtacccggtaacggccttacccggtccccgtcggttaccgtacccgttcctccggttacccccggcctttaccccgg

SEQ ID NO: 2843 - DNA, 656 bp, Homo sapiens
  misc_feature: GYAE6OF02JGD48.26.21.B10.1.454.CMB.1.raw
  modified_base (235)..(235): a, c, t, g, unknown or other
  misc_feature (235)..(235): n is a, c, g, or t
  modified_base (258)..(258): a, c, t, g, unknown or other
  misc_feature (258)..(258): n is a, c, g, or t
  modified_base (313)..(313): a, c, t, g, unknown or other
  misc_feature (313)..(313): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggaccttcgatgagctgattcagccacctcagtgtccgtcgtccccgaggacagacacgccacatcacctgctcggcagacaagtgganatagaatgctgctgtatacgagngcaggcacgttccctagtttcgactatcctacaagtataacggacgccggtcccngacgggtactcccgtacgtaacccgtaagtttccgtacggtaccttaccgaaccgttcgtaacgggaaactaccgtacgtacccgacttaccggtacgtaaccctacgtccggacgggacccgggacccgtaacgacccggtaaacggacgtaacggacgggtaacgtaccgtaagttacgtacggtacgacggtcggtaggaaccgtaagttaacgttcgttaggtacgttggttacgggacggtacggtacgagtcgtacgtccgtacggtacgtccgacgtcccgtaaggtccctacggtcccgttacggccctaccgttcgtacccgttcccgtacccg

SEQ ID NO: 2844 - DNA, 645 bp, Homo sapiens
  misc_feature: GYAE6OF02HVHXH.26.21.B10.1.454.CMB.1.raw
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
tcagagactatactcacgaccggtgctcgatttagtgtcgtcgcaagagaggaggggggggcctcaggaagcagcatcggaggtgcctcagccatggcatggactccctctcttcctcggcgtccttgcttactgcacaggactccgtggccttcgatgagctgattcagcccaccctcagttcgtccgtcgtccccaggaccagacagcccaccatcacctgctcggacagacaaggttgganatagaatgcngcctggtataccaggagcaggccagtcccttattcggtcacttctacaagtataagacgccgcctagaggactccgtagaccgtatttcgacggcctacgactcgtacggaaccacacgcctactctacaccactcgacggtccgggcccagacccgtaaggacgtcggaacggtacgaacttactagttaccggtacgacggtcgggtaggaagtaacgtcttaaggttaggtaggttggtttacgggacgggttaacggaaccggtcggccgttacggtaccgtaccgggttagtccggaaccggtccggtaacggtcccgttacccggcccccgttaccgggttccaaccgtttcccgggttacccttccccccgtaccgttccccgg

SEQ ID NO: 2845 - DNA, 743 bp, Homo sapiens
  misc_feature: GYAE6OF02FT1VQ.26.21.B10.1.454.CMB.1.raw
  modified_base (244)..(244): a, c, t, g, unknown or other
  misc_feature (244)..(244): n is a, c, g, or t
  modified_base (268)..(268): a, c, t, g, unknown or other
  misc_feature (268)..(268): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggactcgtggccttcgatgagctgacttcagcccaccctcacgtcgtccgtcgtaccccaggtaccagacagccaccatccacctgctcggcagactaagtggganatagaatgctgcctagtacttacngacggcacggccacgtcccttagtttcgctacttcttacaagataaagacgccggcctcgaggctccgtcgaaccgtactttcgtcggcctaccctacgtccgtacgggaacacctacgcctaacgtctaacgaccaacgtccgacgggcccggggaccccgaacgacccgaaacgggtagtacggggaacgggtaaccggaacccgtttaacttacggtttaccggtacggtacgggggtacgggttagggaacggtaaacgttaacggtttaagttaggggttaacgtttgggggtttaccggggaaccggggtaaccgggtacggtaaccgggtagttaccccggttaccgggttacccgtacggggttaacccaaccgggtaaccccgtaagggtccccgtttacccggccccggttaccgggttcccctaaccggtccccggttttacccggttcccccccggtaccccg

SEQ ID NO: 2846 - DNA, 576 bp, Homo sapiens
  misc_feature: GYAE6OF02I4BYI.26.21.B10.1.454.CMB.1.raw
  modified_base (240)..(240): a, c, t, g, unknown or other
  misc_feature (240)..(240): n is a, c, g, or t
  modified_base (413)..(413): a, c, t, g, unknown or other
  misc_feature (413)..(413): n is a, c, g, or t
  modified_base (451)..(451): a, c, t, g, unknown or other
  misc_feature (451)..(451): n is a, c, g, or t
tcagagactatactcacgaccggtgctcgatttagtgtcgtcgcaagagaggaggggggggcctcaggaagcagcatcggaggtgcctcagccatggcatggatcccctctcttcctcggcgtccttgcttactgcacaggatccgtggcccttcgatgagctgattcacgcccaaccctcagtgtcccgtcgtccccaggacagacagccaccatcacctgctcggcagacaatggganatagaatgctgcctgtacttacagagccacgccacgtcccttatttcggctcgtcttaccaaggtataagacgccgcctacgaggtcctccgcgaaccgtaatttcgcggtctacccacgtccgtaggaacacgacgcctactctacgaccagtcgaacgggtcccggacccncgaaccgaaccggagtaggagggacacgttactgtgcngggtacgtggaagtacagttagttgttacgtggttggacgggtagcgagcgtcgaccgttcgacgtcgtacgacctacgggccaccgtccccgtcgtaccaccgtcctccggttcctccctaccg

SEQ ID NO: 2847 - DNA, 780 bp, Homo sapiens
  misc_feature: GYAE6OF02GM874.26.21.B10.1.454.CMB.1.raw
  modified_base (153)..(153): a, c, t, g, unknown or other
  misc_feature (153)..(153): n is a, c, g, or t
  modified_base (179)..(179): a, c, t, g, unknown or other
  misc_feature (179)..(179): n is a, c, g, or t
  modified_base (225)..(225): a, c, t, g, unknown or other
  misc_feature (225)..(225): n is a, c, g, or t
  modified_base (386)..(386): a, c, t, g, unknown or other
  misc_feature (386)..(386): n is a, c, g, or t
tcagagactatactcacgaccggtgctcgatttagtgtcgtcgcaagagaggaggggacgtgactcctgtgccccaccatggacacgctttgctccacgctcctgctgctgaccatcccttcatgggtcttgtcccagatcaccgttgaaggngtctggtacctgcgcgtggtggaacncccagcagaccctcacgctggacctgtctccgtctgtcgactttcncaactcaaccacgtactaggacggtgaagtggtcggacctcgggtctacgaccgggtacccccggaaaggccccgttgggagttcggcgtttcgacctacgtcttaagttaccgtaggaagtcgagtcgttcgaacggtcggttaactaaacgttcccgtnttaaccgtgggtaaacgacgttcgaacgtacctaaccgactaccggaaccgaagggtacccctaaacccgtaacggtaaacggtaccccgggtttacgtaacccgttaactaaccgtaccggtaccgtaaacgtaacgtacggaaaccttaccgtaggtaaccggaccgtaaaggtccgtaacggaaccctaaagttacgtaaccgttaggtaccacgaaacctaccggtaccgttaccgtaaccggggacttacccggtacgtaaacggtaacgaaaactacggttacgtaacgtaacggtttacggtaccggggaacggttaaacggttatttacccggggaacccttaccggttacccgtaccccccgtaggttaccccgtaaaccccggg

SEQ ID NO: 2848 - DNA, 741 bp, Homo sapiens
  misc_feature: GYAE6OF02HIXPC.26.21.B10.1.454.CMB.1.raw
  modified_base (234)..(234): a, c, t, g, unknown or other
  misc_feature (234)..(234): n is a, c, g, or t
  modified_base (403)..(403): a, c, t, g, unknown or other
  misc_feature (403)..(403): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattggganatagaatgctgcctggtattaccagaggccaggccacgttccccttattttcggtctattccttaccgaagtataaacggaagccggtacccctcgacgggtactcccgtagacccgtaatttccgcggtctaccaactcgtacgggaacacacgcccactctcgaccntccgacgggccgggacccacggaccgaaccgggagtacgggaagggaacgtaccgttaacgttaacgtttcggtaccggtacgggtacgggttacggggaacgtaaacgttaacgtttaacggtttagggtttacgggttttaggggttttagggggacccggggtaaacgggggtaaacccgtaaggggtaccgtttacggggtaccccgtttacccggggttaacgggtaaccccggtaaccgggtaccccggtaaacgggtcccgttaccccggtccccccgttacgggttccctaacccggtttcccgtttcccggttacccccttacccccgg

SEQ ID NO: 2849 - DNA, 624 bp, Homo sapiens
  misc_feature: GYAE6OF02IME2S.26.21.B10.1.454.CMB.1.raw
  modified_base (388)..(388): a, c, t, g, unknown or other
  misc_feature (388)..(388): n is a, c, g, or t
tcagagactatactcacgaccggtgctcgatttagtgtcgtcgcaaagagagagggggcgtgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatccacctgctcgcagacaaagttggagatagaaatgctgctggtattaccagacggcacgcctacgtaccctattttcggctactcttccaagtaagtaagaagccggtacctagaggactaccgtacgaccgtaagttacgtgctacctaacgtctaggaacacacgccactcctnactatacgacgcggggacccacgaccgaacggacgtagggaacgggacgtacgttaacgttattacggtcgaacgggtacggtagggaacgtaacggtaacttatttacggtagttaggtttacgggacgggtacgggtaacgtaggacgttacggaaccgtcgtaacggtcgaccgacccggaaggtaccgtccgacccgttaccggtccgtaccgtaccgttcccgtaccccgg

SEQ ID NO: 2850 - DNA, 644 bp, Homo sapiens
  misc_feature: GYAE6OF02JB09B.26.21.B10.1.454.CMB.1.raw
  modified_base (233)..(233): a, c, t, g, unknown or other
  misc_feature (233)..(233): n is a, c, g, or t
  modified_base (323)..(323): a, c, t, g, unknown or other
  misc_feature (323)..(323): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattgganatagaatgctgcctggtatacagagccagccagtccctagtttgcatctacagataagagcgcctgaggactccgtgaccgtaatttcgnggcctaccgaactcgtaggaaccacgacgccactctacgacctatcgacggccggggacccaacggacccgaaacggagtacggaaggggaccgtaacttaacgttaacgtttcgtaccgagggtccggtagggaacgtaagttaaccgttagtttggttaaggtttggtttacggggacgggtaacgggaccgtagggtccgtaccggtacccggtccgtacgggtaccgaaccggtacccgtaacgggtcccgttacccggtcccccggttccggtaccccgttaccgttcccggttacccgttccccccgttaccccg

SEQ ID NO: 2851 - DNA, 750 bp, Homo sapiens
  misc_feature: GYAE6OF02HQ67R.26.21.B10.1.454.CMB.1.raw
  modified_base (182)..(182): a, c, t, g, unknown or other
  misc_feature (182)..(182): n is a, c, g, or t
  modified_base (544)..(544): a, c, t, g, unknown or other
  misc_feature (544)..(544): n is a, c, g, or t
  modified_base (741)..(741): a, c, t, g, unknown or other
  misc_feature (741)..(741): n is a, c, g, or t
tcagagactatactcacgaccggtgctcgatttagtgtcgtcgcaagagaggagggggggcctcaggaagcagcatcggaggtgcctcagccatggcatggatccctctcttctcggcgtccttgcttactgcacgaggactccgtggccttagatgagtctgacttcacgacctacccctnaggtcgtccgtacgtcccccaagggaccaagaccacgcccacctatccacctgccgtcggacaacgaactaaagttgggaagtattaaggaaagtgaccgtgacctacgggtaacttaaccgaggacggtaccgaaggtcccgtacggttccccgttaatttacggtactaccgttccttaccaaagtaagtaaacgaaccggtccggtacctaccgtaacgggtaacttccccgtacggaaccgttaacttttccgtcggtaaccctccgtaacttccggaacgggtaaaccaaccgtacgacccgtaactcgaccgacctacgtacggaacggcccgggtaccaccggacgaaaccgggngttacgggaggtaacgtaccgttaattacggtcgttacccgagggtcgtaaggtacgaagttagttacgttagggtcgtttagggtcggagggttaccgcgacggtaccgtcggaaccgttccgaagttccgaaggttacccgaggtcccgtaccgtacccgtcgggtccttaacggtcctacgggtttaccccccnccgttaccg

SEQ ID NO: 2852 - DNA, 652 bp, Homo sapiens
  misc_feature: GYAE6OF02JAZU3.26.21.B10.1.454.CMB.1.raw
  modified_base (108)..(108): a, c, t, g, unknown or other
  misc_feature (108)..(108): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (637)..(637): a, c, t, g, unknown or other
  misc_feature (637)..(637): n is a, c, g, or t
  modified_base (645)..(645): a, c, t, g, unknown or other
  misc_feature (645)..(645): n is a, c, g, or t
tcagagactatactcacgaccggtgctcgatttagtgtcgtcgcaagaggagagggggggcctcaggaagcagcatcggaggtgcctcagccatggcatggatccctntcttctcggctccttgcttactgcacaggatccgtggaccttgatgagtctggattcgacggccctaaccctgaggttgtcccggtgtaccccaggaccaggacctaacggccctaccattccaaccgttgccgtcggcttaaggacctaaaagttggggataattaggaaatgctgtcctaggttataccgagacggaccagggcctaacggttcccctagttttaggtcctattccgttacaagtacaagagaccggcctgacgggtactacccgtgaccgtattttcgnggtcctactaagtccgtagggaacagaccnccgactccgtaaccgtcacacggtacgggcccacgaccgtaacggtcgtacggacggaactacgtacttacgttagtcggtaacggtcgtaacgggataacttaacggttagttacgttaggtgtttacggagacgggttacgaacggcggtactacgcgtacgtacgacgtaccggagtccgtccgacccgtcgtaccacgttccncgttcccncctaccg

SEQ ID NO: 2853 - DNA, 703 bp, Homo sapiens
  misc_feature: GYAE6OF02HILM2.26.21.B10.1.454.CMB.1.raw
  modified_base (255)..(255): a, c, t, g, unknown or other
  misc_feature (255)..(255): n is a, c, g, or t
  modified_base (495)..(495): a, c, t, g, unknown or other
  misc_feature (495)..(495): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcacgcccaccctctagtcgtccgtcgtaccccgaggacagacacgcccaccatccaccgtgccgtcggacaaggaacaaaggttgggaanagtaagaatgctgccttaggtacttaacgaggacggccaacggcctacgtccccttagttttcgcctattccgtaccaaaagtactaaacggaacggcccgcccttacgcgggtaacctccccgtacgaacccgttaatttccgtcggtacctcctaaacgtccgtaacggaacaccacgacccaccgtctacgaaccctactcggaccgggtccggggacccacggtaccgtaaacggngtacgggacggactaacgttactagtcgtacgacgggtcgggtaagactaagttaaccttagttacggttaggttacggttacgggacggtacgggacggtacggtacgtaccgtaccgtaccggtacggtccgtaacggacccgtcggaccgttccccgacccgttccgggcctaccgttccgtcccgttcccccgtcgttaccccg

SEQ ID NO: 2854 - DNA, 751 bp, Homo sapiens
  misc_feature: GYAE6OF02HGC27.26.21.B10.1.454.CMB.1.raw
tcagagactatactcacgaccggtgctcgatttagtgtcgtcgcaagaggagagggggctgggcctcaggaagcagcatcggaggtgcctcagccatggcatggatccctctcttcctcggcgtccttgcttactgcacaggatccgtggccttcgatgagctgattcgacgccaccctgagtcgtccgtcgtaccccgaggacagacgcgaccaccactccacctcgacctcggacacgacaaagttgggagataagaatgctgcgtagtataccgaggacggcgacgaccgacgttcccgttattttcggactacttctacgaagagtaagacgccgccgtcgacggtactccgtaggtaccgttattcgcgtcctaccgtaacgttacgtacgggaaaccacgaccgtacccgacttctacgacctagtaccgaccgggtacccgggacccaccggaaccggaaacgggtacgtacggggaacggggaactaaccgttacgttaacggttcgtacggacgggtacgggtaacgggtaagttaaaccgttaacgttaggttttacgggttaacggttttcggggtttaacgggcggggttaaaccgggaccggttaggtaacccggtaccgggttacccggttaccggttaacgggttccggaaacccggtacccggtaaccggcccgttaccccggtaccccggtcggtttacccacccgggtttacccgtaccccggttaccccccg

SEQ ID NO: 2855 - DNA, 684 bp, Homo sapiens
  misc_feature: GYAE6OF02GCFN7.26.21.B10.1.454.CMB.1.raw
  modified_base (257)..(257): a, c, t, g, unknown or other
  misc_feature (257)..(257): n is a, c, g, or t
tcagagactatactcacgaccggtgctcgatttagtgtcgtcgcaagagaggagggggggggcctcaggaagcagcatcggaggtgcctcagccatggcatggactccctctcttcctcggcgtccttgcttactgcacaggactccgtggccttcgatgagctgattcacgccacctgagttcgtccgtcgtccccgaggacagaccacgcccacactccacctgccgtcggacaacgtaacaaaggttcgggaanagtaagaaatgcgtgtctaggttactacgaagacggccacgccacgttcccttagtttcggtactacttcgtacgaagtactaagacggccgcctacgacggacttaccgtacgaaccgtactttcgcgccttaccgtaactcgacgggaacacacgaccgtactaccacgacacgtcgacggcccggaccacgaccgaaggtacgtacgggaacgggaataccgtaacgttcttacgcggtacggtcgggtaacggtaagaacgttacttaggttaggttaggtttagggttcgggacgggtacgacggtacggacggttaccgaccggttacggtacggtacctaccggacccggtaacgcccggttccgccccggtacgtcccttacccggtccgtttaccccggttcccctacccgttacccg

SEQ ID NO: 2856 - DNA, 803 bp, Homo sapiens
  misc_feature: GYAE6OF02JA264.26.21.B10.1.454.CMB.1.raw
  modified_base (433)..(433): a, c, t, g, unknown or other
  misc_feature (433)..(433): n is a, c, g, or t
tcagagactatactcacgaccggtgctcgatttagtgtcgtcgcaagagaggagggggctgggcctcaggaagcagcatcggaggtgcctcagccatggcatggatccctctcttcctcggcgtccttgcttactgcacaggatccgtggccttcgatgagctgattcagccaccctcagtgtcccgtgtccccaggacagacagccaccatccacctgctcggcagacaagttggagatagaatgctgctggtacttacgagcgaccaggcccacgttccccgttagttttcggtctagttccgttaccaagtactaacggaagcccgtaccctacgtacggactcccgtaccggtaccgtagtttccgtgggtaccctaccgtaccgttacgtacgggaaacctacgactaccctaactccgtaccaaccnctacggacccggtccgggacccgacggtacccgaaaccgggtagttaggaacgggtaccttaaacgtttaacctagttttacccgggttagaacggggtccgggtaacggggtaaacggtaacgtttaaccgtttaggtttaccgggtttagggtttaggggtttaccggggtaccgggggttaaaccgggttccccgggtaaggggttacccggttaccggggttaaccccggttaaccgggttcccggggttttaccaacccgggggtaaccccgttaaacccggttccccgggttaccccggtccccccgggttaacccggttcccgggtaaccccttttcccccggggttccctttaccccccccg

SEQ ID NO: 2857 - DNA, 753 bp, Homo sapiens
  misc_feature: GYAE6OF02GZMA1.26.21.B10.1.454.CMB.1.raw
  modified_base (177)..(177): a, c, t, g, unknown or other
  misc_feature (177)..(177): n is a, c, g, or t
  modified_base (340)..(340): a, c, t, g, unknown or other
  misc_feature (340)..(340): n is a, c, g, or t
tcagagactatactcacgaccggtgctcgatttagtgtcgtcgcaaagagagaggggggggcctcaggaagcagcatcggagtgcctcagccatggcatggatccctctcttcctcggcgtccttgcttactgcacaggactccggtggccttcgatgagctgattcagccaccctnagtgtccgtcgtccccaggaccagacagccaccatccacctgctcggcagacaaagttgggagatagaatgctgcctggtacttaccgaggacggcccaggccacgtccccttatttcggtcatccttaccaagtataagacggccgccctacgaggtctccncgacgtattcgtggcctaccactcgtagggaaccacgacgacctaccgtcacgtaccctagtacccgacgggccccggggacccacgggacccgtaaacgggaccgtaagggaaccgggtaacgtaaccgttaaccgttaagtttccggtaaccggtaggggttccggttaagggggaaacgttaaacgttaaccggtttagtttaccgggttagggtttacggggttttacggggaaccgggtaacggggtaacccgtacgggtaccgttacgggaaccccgtttacggttaaccgggtaccgtaacccgggacccggtaacgggtccccgtaccggttccccccgttaccgggttacccttaaccccggtttcccggtcccggtttaccccccggtccccgtttaccccgg

SEQ ID NO: 2858 - DNA, 860 bp, Homo sapiens
  misc_feature: GYAE6OF02JKR5N.26.21.B10.1.454.CMB.1.raw
tcagagactatactcacgaccggtgctcgatttagtgtcgtcgcaagagaggagggggggggcctcaggaagcagcatcggaggtgcctcagccatggcatggactccctcttcttccgtcggcgttccttgtcttactgcaacgaggactccgtcgtccttcgatgagtctagattcacgcccacctcagtcgtccgtcgtcccgaggacagacacgaccacctactccaccgtcgcgtaccgacaacggaactaaaggttgggaatagtaaacgaaacgtgccgttacggtacggttacggtaacgtaaccgacggaccgggaccgcggtacccgttaaccgttccccgttttaagttttacgacctacttccttaacggaaaaggttaaagtaaaccggaacgggtcccggtacccgtacgggtaacggtcctacccgtaccggttaaacgtttaacgtttccggtccggtaaccttaccgtaaaccggtccggttaaacgggaacctaccggtaacgtccctaaccgttaccgtaacccgaaccgtacgttacccgggaccggggtaccccgggaaccgaaccgggtaaaccgtaaccggggtagtaacgggtaacggggtaaacttaccggttacttaggtccggtaaacggtacggggtaccggtaaagggactttaaagttaacgttaaggtttcggttaaggttcggggttaacgggaaccgggtacgggacgggttacggtacccgggtaacgttaccgtacgggtagtacccgtaacggccgtaacggtccgtaccccggtacgtcccgtacccgttcgtacccggtcccggtttacccgccgtttcccg

SEQ ID NO: 2859 - DNA, 715 bp, Homo sapiens
  misc_feature: GYAE6OF02H0MZD.26.21.B10.1.454.CMB.1.raw
  modified_base (254)..(254): a, c, t, g, unknown or other
  misc_feature (254)..(254): n is a, c, g, or t
tcagagactatactcacgaccggtgctcgatttagtgtcgtcgcaagagaggaggggggctggggcctcagggaagcagcatcgggaggtgcctcagccatggcatggactccctctcttcctcggcgtccttgcttactgcacaggatccgtggccttcgatgagctgacttcacgccacctcagtcgtccgtcgtcccgaggacacgacacgaccacctactccacctgcctacggacagaacaagtggganagtaagaaatcgactcgaccgttaggtacttaccgaggacggaccacggaccctaccgttacccctttagttttcggactacttccttaccaagtaactaaaggaacgcccggacctacgacgggtacctcccgtagtaccgtagtttcgacggtctacccaacgttcgtaacgggaaccactacgaccctacgtccacggacctacgtccgaacgggtacccggggacccctaacggacccgtaaacgggacgtagggaacggggtaactaaccgttaacgtagtttccgaacggtacgggtacgggtagggaactaaacgtttacgttaagtttagtaggttacggttcgggacggtacggaccgaggtcgtacggtccgttacggaggttccgacggacccgtaacgggtccctacccggtccccgtaggtacctaccggttccgttccgtcccccgg

SEQ ID NO: 2860 - DNA, 833 bp, Homo sapiens
  misc_feature: GYAE6OF02F4D54.26.21.B10.1.454.CMB.1.raw
  modified_base (177)..(177): a, c, t, g, unknown or other
  misc_feature (177)..(177): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttgatgagtctgattcacgccaccctnaggtcgtccgtcgtccccgaaggacacgacgacgcccaccgtaactcccaccgtcgaccttcgggacctaacggaactaaaaggttcggggaaataacgtaaggtaaacgttcggaccgtcgtacgttacgggttaacttacccgaaggtaccggaccgacggtaccctaccgttaccccttttagttttaggtacctacgttaccgttaaccgaaaggtaaacgtaacggaacggacccggcccttacggacgggtacctacccgtagtaaccgtactttcggacgtacctacctaaccgttcggtacggaactaccgacgccctagtaccgtacgaacctcggtaaccgcgggtacccggacccaacggacccgtaacggtacggtacgggaaggtaaccgtaccgtagttacgttacgtacggtacgggtcgggaacgggtaaactaagttaacgtttacgtttagttagggtttacggtttacgggacggggtaacggaccggtaacggtaccggtaccgttacccggtaccgtaccgggttaccgaaccggttaacccgacgggtaccccggtacccgttacccccgggactttaccccggttaaccctttcccgggttcccccggttacccgtccccggtttaaccccgg

SEQ ID NO: 2861 - DNA, 864 bp, Homo sapiens
  misc_feature: GYAE6OF02IETYA.26.21.B10.1.454.CMB.1.raw
  modified_base (118)..(118): a, c, t, g, unknown or other
  misc_feature (118)..(118): n is a, c, g, or t
  modified_base (190)..(190): a, c, t, g, unknown or other
  misc_feature (190)..(190): n is a, c, g, or t
  modified_base (255)..(255): a, c, t, g, unknown or other
  misc_feature (255)..(255): n is a, c, g, or t
  modified_base (524)..(524): a, c, t, g, unknown or other
  misc_feature (524)..(524): n is a, c, g, or t
tcagagactatactcacgaccggtgctcgatttagtgtcgtcgcaagagaggagggggggcctcgaggaagcagcatcggaggtgcctcagccatggcatggactccctcttcttccncggcgttccttgcttactgcacgaggactccgtggtccttacgatggagtctgtattcacgccctacctacngttcgtccgtcgtaccccgaggacagaccgacgacccaaccactccgaccgttgccgtaccgganaacgtaactaaaggttgggaatataaagaattcggacgtcggtaccgttagtaacttaacgcggaacggcccgtaacggacccgttaccggtttacccctttttaaggtttttcggtacccttattttaccccgttaacgaaacggtaataacggaaccgggtccccggtaccttacggaacgggtttaccaccccggtaggtaaacccttagttttcccgaccggtcctaccgttaaccgtacgtacggtaaaccacgacccgttacncccgtttaactacccgtaacgtcgtacggaaccggggccccggtaaacccgaccggtaaaccggtaccggtggaaaccgggaaaggggtacccttaaactttaaggtaccggtttacggtcggaaaccgggggttacgttacggggaaacgttaaccttaggttttacgttagggtttacggtacgggtttacggggacggtacgggtaacgtcgggttacctaccggggttcgtaccggtagggtaccgtaaccgggaccgtaaccggttcccaacccggttacccccgtcgggtaacccttcggtttccccgtaccccggtttccctccccggttacg

SEQ ID NO: 2862 - DNA, 686 bp, Homo sapiens
  misc_feature: GYAE6OF02I8338.26.21.B10.1.454.CMB.1.raw
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (348)..(348): a, c, t, g, unknown or other
  misc_feature (348)..(348): n is a, c, g, or t
tcagagactatactcacgaccggtgctcgatttagtgtcgtcgcaagaggagagggggctgggcctcaggaagcagcattggaggtgcctcagccatggcatggatccctctcttcctcggcgtccttgcttactgcacaggtactccctggccttcgatgagctgattcagccaccctcagtgtcccgtgtccccaggacagacacgccaccatcacctgcctcggcagactaagttggganatagaatgctnccgtgtactaccgagnggaccaggccagtcccctatttcgcatcgttccaagtataagacgcgtccctgacggctcccgtagaccgtaattcgnggtacctacctactcgtagggaactacagtacccactcgtacaaccctagtccgtaacggcccggggtacccacggtacccaacgggtactacgggaacgggtacgtaacttacgtacgtttcgacggtaacgggtcggtacgggaacgttaaactaaccgtttaggtttacggttaaccgttggggttttacggggacggggtaacgggtaaccggtcgggttacgtacccgggaccgtttaccggtaagggttacccgtacgggacccgtaacgggttcccgtaccggttcccccggtagttcccgaccgtttaccgtccccggtttaaccccccg

SEQ ID NO: 2863 - DNA, 728 bp, Homo sapiens
  misc_feature: GYAE6OF02GGH5P.26.21.B10.1.454.CMB.1.raw
  modified_base (213)..(213): a, c, t, g, unknown or other
  misc_feature (213)..(213): n is a, c, g, or t
tcagagactatactcacgaccggtgctcgatttagtgtcgtcgcaagaggaggaggggggggcctcaggaagcagcatcggaggtgcctcagccatggcatggatccctctcttcctcggctccttgcttactgcacaggatccggtggcctttcgatggagcgtagattcacgcccaccctcgagtcggtccgtcgtccccgaggacagacngccacactccacctgctcggacaggaactaaagttgggacaagtaagaagtcgcgtcgccgttaggtacttaccgaggacggaccgacggccgtacgttcccgttagttttcggccttagtccttaaccgaacgtagtaaacggacgcccgggtaccctaggacggtacctacccgtacgaccgttactttcgtaccgtaccgtcctaacgtcgtacgggaaacctccgacgtcctaacgtcctacggacctagtccgacgggacccggaccgaccgaccgtaacggaggtacggtacgggacttaacctgttacgtcgtaccggtagggtaccggaggaagtaccgttagttaggttcggttagtttgggtacgggacgggtacggacgacggttcgacggtacccgttcgggaacggttccgacccggtaaccggaccggttcccgttccggtaccccccgttcggttacccgtccgttccccgaaccccggtttccccgtacttacccccgg

SEQ ID NO: 2864 - DNA, 760 bp, Homo sapiens
  misc_feature: GYAE6OF02G3FOB.26.21.B10.1.454.CMB.1.raw
  modified_base (248)..(248): a, c, t, g, unknown or other
  misc_feature (248)..(248): n is a, c, g, or t
  modified_base (349)..(349): a, c, t, g, unknown or other
  misc_feature (349)..(349): n is a, c, g, or t
tcagagactatactcacgaccggtgctcgatttagtgtcgtcgcaagaggaggaggggggggcctcaggaagcagcatcggaggtgcctcagccatggcatggatccctctcttcctcggctccttgcttactgcacaggatccgtggtccttcgatgagctgattcagcccaccctcgagtgtccgtcgtccccaggaccagacacgccaccatccactcgctcggcaaggacctaaagttgggaanaactaaggaaatcggactcgccttaggttaacttaccgaggtaaccggcaggaccacgtccccttagtttcggactactgtaccaagtacaagacgcgccngaggacctccaggacctaattccgagtcctaccaatcggtaacggacacgacgacctactaccgtcgacccagttacccggaacgggcccggtaacccgtaaggaaccccgtaaccgggaagtcgggtaaacggtacgtaaaccttacggttactttacgggaccgtaacgggttcgggtaaacggtaacgtttaaacgttaacggttacgtttaacgggtttaggtttaacgggtttcggggtaaccggggttaacggaacccgttaggtacccggttacggtaacccggttttccggacggtttacccgaaaccggttacccgtaaccgggtaccccgttacggttaccccccgttacgggttaccctaccccgtttcgttaaccccggtcccttaaccccgttacccg

SEQ ID NO: 2865 - DNA, 802 bp, Homo sapiens
  misc_feature: GYAE6OF02GIH46.26.21.B10.1.454.CMB.1.raw
  modified_base (366)..(366): a, c, t, g, unknown or other
  misc_feature (366)..(366): n is a, c, g, or t
  modified_base (696)..(696): a, c, t, g, unknown or other
  misc_feature (696)..(696): n is a, c, g, or t
  modified_base (725)..(725): a, c, t, g, unknown or other
  misc_feature (725)..(725): n is a, c, g, or t
  modified_base (760)..(760): a, c, t, g, unknown or other
  misc_feature (760)..(760): n is a, c, g, or t
tcagagactatactcacgaccggtgctcgatttagtgtcgtcgcaagagagacggggggactcctgtgccccaccatggacacgctttgctccacgctcctgctgctgaccactcccttcactgggtccttgtccccagactcaccttagaacggagtctggtcctgcgcgttacggtggactccccgagtccacgaccctacaccgcttacgacctcgccttcccggtacttcgtaggacttctcacctccaccgacgacgtcggacggtagaacgttggtcggccttacgggttcccgcgaccgggacccccgggtaaaggccccgttagggacgtcggtcttacccacgttcctatttaccgnggtactggtaacttccgtacgaacggtaccggtacctaaccgttccgtacttccgtaggggaaaccggtacttccggtaaccctacggaacccctacgacccgtaaccgtaacggtaacccctacccgtaaacccggtaaccggggtacccggggttaccgttaacccgtttaacaccggttaccgaaccccggtactacgttacgtaacccttaccggttagggacgaaccgtacgaccgaaactcgttaaacgtcttaacgtcgtacgaccctaccggtactaccggtacgtacgaccgtaacgtaaccggtaccaaagtaaaccgtntacgtaccgtactcgggtacgggtaacgngggtttaacgttacccggacgtaccccggttaccncccgtaaccgtccccgtaaccggtaaccggtacccgtacccg

SEQ ID NO: 2866 - DNA, 652 bp, Homo sapiens
  misc_feature: GYAE6OF02F6H78.26.21.B10.1.454.CMB.1.raw
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (398)..(398): a, c, t, g, unknown or other
  misc_feature (398)..(398): n is a, c, g, or t
tcagagactatactcacgaccggtgctcgatttagtgtcgtcgcaagagaggagggggggggcctcaggaagcagcatcggaggtgcctcagccatggcatggactccctctcttcctcggcgtccttgcttactgcacaggactccgtggccttcgatgagctgattcagtccaccctcagtcgtccgtcgtccccaggacacgacacgccacctatccacctgctacggcaagacaaagttgggaanatagaatnctntcgtagtataccgagcgcgaggcctacgttccctatttcggatactcttaccaagtacaagacggcctaccgtcgacggtacctccgtacggtaccgttattcgacggtcctacacgtcggaagaccacgaccacctntaccgacgtacccagtccggacggcccgggaccacgggaaccaacggtacgtacgggacgggacgtaaccttaggttacgttcggacggtacggcgggtacggaagttaactagttacggttaggttaggtttaggttcggggacggcgggtacgagggtcctaccggtccggtaccgtagtaccggtaccggacccggcgtcgtaccccgcccgttcggtacttcccgtacttcccctacccgttaccctccg

SEQ ID NO: 2867 - DNA, 920 bp, Homo sapiens
  misc_feature: GYAE6OF02HLRNJ.26.21.B10.1.454.CMB.1.raw
  modified_base (301)..(301): a, c, t, g, unknown or other
  misc_feature (301)..(301): n is a, c, g, or t
tcagagactatactcacgaccggtgctcgatttagtgtcgtcgcaagagaggagggggctgggcctcaggaagcagcatcgggaggtgcctcagccatggcatggatccctctcttccgtcggccgtccttgcttactgccacgaggactccggtggtcccttacggattagacgtcgttagtacttccacgcccctacccctacgacggttcgtcccggtaccgtacccccgaaggaccaacgaccgacgcccaccactaccaccgtgccgtaccggacaacgtacgtaaaggttggaanaagtaaagaagtcggtacgtacgtccgtaggttaccttaaccgaggacccggaccgtaccggtaccctaccgtttaccccgtttaggtttccggaccttacctaccgttaacgaaagtacgtaacggaccggccgtacccgtaggaccggtacctaccgacgtaaccgttacgtttcgacgtacctaccgtaacgtacgtacggaacctacgtaccgacctaccgtacgtacccgaacgtaaccgtcggaaccgggtaccccgggaccctaaccggtaacccggtaaacggtaacgggtaaccggggaacgggttaacccgtaaacgtttaccggttaacgttacgggtacgggtaaccggggttaagggtaaacgggtaaagtttaaaccgttaaagggttttacggtttaacggggtttagggttttaccgggggttaaacgggggcccggggttaaacgggacccgggttacggtaccggttacccggttaacccggttacgggtaaccggtcccggtaacccgggtaaccggtaaccgggtccccgttaaccccggttccccgggttaccgttacccggtttaccccgtttacccggttccccccgttaccccgg

SEQ ID NO: 2868 - DNA, 686 bp, Homo sapiens
  misc_feature: GYAE6OF02JNEWN.26.21.B10.1.454.CMB.1.raw
  modified_base (524)..(524): a, c, t, g, unknown or other
  misc_feature (524)..(524): n is a, c, g, or t
tcagagactatactcacgaccggtgctcgatttagtgtcgtcgcaagagaggagggggggcctcaggaagcagcatcggaggtgccctcagccatggcatggatccctctcttcctcggcgtccttgcttactgcacgaggactccgtggccttcgatgagctgattcgacgccacctcgagttcgtccgtcgtcccgaggacacgtacacgccacataccgacctcgctcgacagtactaagttcggagtataaggtaactgtcgtgccgttaggtactaccgagacgccgagtaccctacgttcccgttagttcggactacttccgtaaccgaaggtaacgtaacgaccgccgtacccgtagtacggccttaccgagtaccgtattccgcgtacctacgaactacgtacggacactacgaccgtactacggtacaccgtacgtacgaccggtacccggacacggtacgaaccggtagtacggaacgggtactaacgtacgtacggtcgtacgtacgggtagngggtaactacgttaggttacttaggttagtcgggttacggacgggacgtacgtacggacttacggacccgttggtacgttaccggcgttaccggtctccggttacccgtcccgtaccggtttcctacccgtccggtttacccggtacccctcccgttaccgg

SEQ ID NO: 2869 - DNA, 818 bp, Homo sapiens
  misc_feature: GYAE6OF02I4SZG.26.21.B10.1.454.CMB.1.raw
  modified_base (183)..(183): a, c, t, g, unknown or other
  misc_feature (183)..(183): n is a, c, g, or t
tcagagactatactcacgaccggtgctcgatttagtgtcgtcgcaagaggaggaggggggggcctcaggaagcagcatcggaggtgcctcagccatggcatcggatccctctcttcctcggccgtcctgcttacacacgaggattccgtggtcccttgatgagctgacttcgacgccaccctnaggttcgtcccggtcgtcccccgagggacctacggaccacgaccctaccactccgaccgtcgccgtacgaccgaaagtaccgtaaagttacggggataagttaaggaaacttggaccttacgtaccgttaggtaaccttaaccggaggaccggaccacgggccctacggtacccctttaggtttcggtaacctacttaccgttaaccgaagtaacggttaacgaaacggccgtacccgtagaacggtcctacccggtagtacccgtatttccgcggtacccaccgtaagtcgtaaacggacccagtaccctcctaacgtcctaaccgactacgaccggaccggaccggtacccacggtaccggaacggtaggtacggaacggtacgaaccgttaacgtacgtttacgccggtaacggtacggtacgggtaacgtacgtttaacggtaagtttgggttaacgttacggttcggggtaacggggtaacggtacccgggttaaggtacccggttaccggtaaccgggttaccgacggtaaccgaccggtacccgggtaacggtcccgtaaccccggtccccggttaacggtccgttacccggttaccgtccccgtttacccgtacccttaccgttacg

SEQ ID NO: 2870 - DNA, 626 bp, Homo sapiens
  misc_feature: GYAE6OF02IAU0I.26.21.B10.1.454.CMB.1.raw
  modified_base (131)..(131): a, c, t, g, unknown or other
  misc_feature (131)..(131): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (376)..(376): a, c, t, g, unknown or other
  misc_feature (376)..(376): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
  modified_base (541)..(541): a, c, t, g, unknown or other
  misc_feature (541)..(541): n is a, c, g, or t
tcagagactatactcacgaccggtgctcgatttagtgtcgtcgcaagagaggagggggcctcaggaagcagcatcggaggtgcctcagccatggcatggactcctctcttccgtcggcgtcttgcttactncacaggctccgtgtccttagatggcgctgattccacgacccaccctgtagtccgtccgtcgtaccccgaggacagaccgacgacccaacacgtccacgtcgcgtacggacaagaacgtaagttgggaanagtaagtaacgngtcgtacgccgtaggtacttacgaggaaccgcacgccgtacgtaccttacgtttcggactacttcctaacaacgtattaacggaacgcgcctagacggactccncgaacgtattcgacgcctacaacgtgacggaacncgaccncnctcgctacngtccacgggtcccgacctacggacccgtacggagacggaaaggactacttaacttggacgttcgaaggtcgggttagaagtaccttatacggttgttagtcggtagcgggtaanccgagcgacgcgtacgtacgctacgaccgacggtcctaccgtccggtaccgtactccgttaccgccctttacccggccttaaccg

SEQ ID NO: 2871 - DNA, 734 bp, Homo sapiens
  misc_feature: GYAE6OF02IHT40.26.21.B10.1.454.CMB.1.raw
  modified_base (117)..(117): a, c, t, g, unknown or other
  misc_feature (117)..(117): n is a, c, g, or t
  modified_base (187)..(187): a, c, t, g, unknown or other
  misc_feature (187)..(187): n is a, c, g, or t
tcagagactatactcacgaccggtgctcgatttagtgtcgtcgcaagagaggaggggggggcctcaggaagcagcatcggaggtgcctcagccatggcatggactccctctcttccncggcgtccttgcttactgaccacaggactccggtggtccttcgatcgagctgtaattcacgcccaccctnaggttcgtccgttcgtccccgaggacagacacgtcccaactatccaccgtgcgtaccggataacggaacctaaaggttgggaacgataaagaaagtcgcgtacgtccgtaggttaactaccgacggacggaccaacggtacctaccggttacccctttaagttttcggcctaagtttccttaaccgaagtactaaacgacggcccgtaccctacgacgggtactcccggttagaccgttaacttcgtacgcctaccgaaccgtcgtacggaacacgacgaccctatccgactacgctaccggacggtcccggacccacggaaccggaacgtcgtaacggaggtacacttacgtacgtcggtacgacggtggacgtagtaaccgtagttaagttggttacgttgggttacggaggggaccggacgtacggcgtccgtaaccgttccggtaggcccgtaaggttacccggacggttaacccgttcccgtaaccccgggtcgtaaccccttcccgtttaccgtaccccgttcccccgttacccgtacccg

SEQ ID NO: 2872 - DNA, 607 bp, Homo sapiens
  misc_feature: GYAE6OF02JJBOI.26.21.B10.1.454.CMB.1.raw
  modified_base (139)..(139): a, c, t, g, unknown or other
  misc_feature (139)..(139): n is a, c, g, or t
  modified_base (182)..(182): a, c, t, g, unknown or other
  misc_feature (182)..(182): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
tcagagactatactcacgaccggtgctcgatttagtgtcgtcgcaagagaggaggggctgggcctcaggaagcagcagtcggaggtcgcctcagccatcggcgatggactccctctcttcctcggcgtccttgcttacngcacaggatccgtgccttgatgagctgacttcagcccaccctnacgtcgtcccgtgtccccgaggaccagaccacgccaccagtccaccgtgcctcggcaacgaacaaagttggaacatagaaagtcgctagtactagtactaccagcgccacggcctacgtcccttagtttcgcacgtctacaacgtataacgacgcggcctgaggctccgtgacctattcgcgctcgaactcgtacggaacncgacnccactcacgaccacgtcgacggccggacccacgacaacggtacgtaggacggacgtacttactagttacgacgaggtcggagtaataacgttagttagtttcgtaggttacggttagggtaccggtacggaccgtacggacgtcgaaccgtcgtacggtaccgaacggtccaaggccctaccggtcccgttaccggactccgttccgtaccgttccccg

SEQ ID NO: 2873 - DNA, 169 bp, Homo sapiens
  misc_feature: GYAE6OF01BLGWN.31.89.I01.1.454.CMB.1.raw
  modified_base (169)..(169): a, c, t, g, unknown or other
  misc_feature (169)..(169): n is a, c, g, or t
tcagcagtagacgtcacgaccggtgctcgatttagtatgctagtatcgcgggggtcttcggagctgggaccaaggtcaccgtcctaggtaagcccaaggccaaccccactgtcactctgttcccaccctcctcacgtctactgctgagcgggctggcaaggcgcatagn

SEQ ID NO: 2874 - DNA, 171 bp, Homo sapiens
  misc_feature: GYAE6OF01DQQJ8.31.89.I01.1.454.CMB.1.raw
  modified_base (171)..(171): a, c, t, g, unknown or other
  misc_feature (171)..(171): n is a, c, g, or t
tcagcagtagacgtcacgaccggtgctcgatttagtatgctagtatcgcgggggggtgttcggcggagggaccaaactgaccgtcctaggtcagcccaaggctgccccctcggtcactctgttcccaccctcctcacgtctactgctgagcgggctggcaaggcgcatagn

SEQ ID NO: 2875 - DNA, 294 bp, Homo sapiens
  misc_feature: GYAE6OF01BGXOP.31.89.I01.1.454.CMB.1.raw
  modified_base (288)..(294): a, c, t, g, unknown or other
  misc_feature (288)..(294): n is a, c, g, or t
tcagcagtagacgtcacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaaggcccatcggtcttccccctggccaccctcctcacgtctactgctgagcgggctggcaaggcgcatagnnnnnnn

SEQ ID NO: 2876 - DNA, 170 bp, Homo sapiens
  misc_feature: GYAE6OF02HSTS2.31.89.I01.1.454.CMB.1.raw
  modified_base (168)..(170): a, c, t, g, unknown or other
  misc_feature (168)..(170): n is a, c, g, or t
tcagcagtagacgtcacgaccggtgctcgatttagtatgctagtatcgcggggtcttcggagctgggaccaaggtcaccgtcctaggtcagcccaaggccaaccccactgtcactctgttcccgccctcctcacgtctactgctgagcgggctggcaaggcgcatagnnn

SEQ ID NO: 2877 - DNA, 169 bp, Homo sapiens
  misc_feature: GYAE6OF02HHCHY.31.89.I01.1.454.CMB.1.raw
  modified_base (168)..(169): a, c, t, g, unknown or other
  misc_feature (168)..(169): n is a, c, g, or t
tcagcagtagacgtcacgaccggtgctcgatttagtatgctagtatcgcggggtcttcggagctgggaccaaggtcaccgtcctaggtaagcccaaggccaaccccactgtcactctgttcccaccctcctcacgtctactgctgagcgggctggcaaggcgcatagnn

SEQ ID NO: 2878 - DNA, 193 bp, Homo sapiens
  misc_feature: GYAE6OF02IUEAR.31.89.I01.1.454.CMB.1.raw
  modified_base (167)..(193): a, c, t, g, unknown or other
  misc_feature (167)..(193): n is a, c, g, or t
tcagcagtagacgtcacgaccggtgctcgatttagtatgctagtatcgcggggtcttcggagctgggaccaaggtcacgtcctaggtcagcccaaggccaaccccactgtcactctgttcccgccctcctcacgtctactgctgacgcggctggcaaggcgcatagnnnnnnnnnnnnnnnnnnnnnnnnnnn

SEQ ID NO: 2879 - DNA, 175 bp, Homo sapiens
  misc_feature: GYAE6OF02FP97T.31.89.I01.1.454.CMB.1.raw
  modified_base (130)..(130): a, c, t, g, unknown or other
  misc_feature (130)..(130): n is a, c, g, or t
  modified_base (165)..(175): a, c, t, g, unknown or other
  misc_feature (165)..(175): n is a, c, g, or t
tcagcagtagacgtcacgaccggtgctcgatttagtatgctagtatcgcgggggtcttcggagctgggaccaaggtcacgtcctaggtcagcccaaggccaaccccatgtcactctgttcccacctcctnacgtctactgctgagcgggctggcaaggcgcatgnnnnnnnnnnn

SEQ ID NO: 2880 - DNA, 185 bp, Homo sapiens
  misc_feature: GYAE6OF02GGFA0.31.89.I01.1.454.CMB.1.raw
  modified_base (171)..(185): a, c, t, g, unknown or other
  misc_feature (171)..(185): n is a, c, g, or t
tcagcagtagacgtcacgaccggtgctcgatttagtatgctagtatcgcgggggtcttcggagctgggaccaaggtcaccgtcctaggtaagcccaaggccaaaccccactgtcactctgttccccgccctcctcacgtctactgctgagcgggctggcaaggcgcatagnnnnnnnnnnnnnnn

SEQ ID NO: 2881 - DNA, 545 bp, Homo sapiens
  misc_feature: GYAE6OF01ACTFW.12.21.B10.1.454.CMB.1.raw
  modified_base (303)..(303): a, c, t, g, unknown or other
  misc_feature (303)..(303): n is a, c, g, or t
tcagatacgacgtacacgaccggtgctcgatttagtgtcgtcgcaagagaggaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctctgcactgggaccagcagtgatgttggacttataacctgtctcctggtaccaacaacacccaggcaaacgccccaaaactcatgatttangagggcactaagcggcctcgtagggtttcttatcgtcttctctggctcgagtctggcaacacggcctcctgaccatctcgtgggtccaggctggaggacgaggctagatttacttactgactagttcaagtactaacaacgtcctaacttcctacgtcgttcggtggttcgtcggcggtggaaccaaggctcgaccgtactaacgtcacgcccgtaaggcctccgccccctggtcctacccg

SEQ ID NO: 2882 - DNA, 529 bp, Homo sapiens
  misc_feature: GYAE6OF01B037B.12.21.B10.1.454.CMB.1.raw
  modified_base (307)..(307): a, c, t, g, unknown or other
  misc_feature (307)..(307): n is a, c, g, or t
  modified_base (502)..(502): a, c, t, g, unknown or other
  misc_feature (502)..(502): n is a, c, g, or t
  modified_base (524)..(524): a, c, t, g, unknown or other
  misc_feature (524)..(524): n is a, c, g, or t
tcagatacgacgtacacgaccggtgctcgatttagtgtcgtcgcaagagaggaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttangagggcactaagcggccctcgaggtagtttctgatcgcttctctggctccaaggctggcgaccgggcctccctgacaatactcgtgggctcgaggctggaggacgaggctcattactactgctgctcatagtggtagttatagctagttgggtgttcggcggacggacaaggtcgacgtctagtcacgccaggcncgcccctggtcactctctcccncctcc

SEQ ID NO: 2883 - DNA, 598 bp, Homo sapiens
  misc_feature: GYAE6OF01A0XAP.12.21.B10.1.454.CMB.1.raw
  modified_base (351)..(351): a, c, t, g, unknown or other
  misc_feature (351)..(351): n is a, c, g, or t
  modified_base (384)..(384): a, c, t, g, unknown or other
  misc_feature (384)..(384): n is a, c, g, or t
  modified_base (418)..(418): a, c, t, g, unknown or other
  misc_feature (418)..(418): n is a, c, g, or t
  modified_base (444)..(444): a, c, t, g, unknown or other
  misc_feature (444)..(444): n is a, c, g, or t
tcagatacgacgtacacgaccggtgctcgatttagtgtcgtcgcaagagaggaggggagtgaggagcagcgctctcgggacgcctccaccatggcctgggctctgctgctcctcactctcctcactcaggacacagggtcctgggcccagtctgccctgactcagcctgcctccgtgtctgggtctccgtggacgagtcgatcaccgtctccgtgcacgtgggaccagtaatgtattttggaaattttgaccttagtctcctggtaaccaacaatacccggacaaagtccccaaagttactcatttatgaggcacgtaagcggccctacgaggtatttcagaatcgcttcnctggctcaagctggcgacggcctcctgacaatntcgtggcctcagctgaggacgaggactcattacnctgcttgctcgatagtggtaagttanacgcgtaacgttggggtacgttcgggcggacgggtaacctaagggttcgtaaccggtccgtaaaggtaccaaggtacccgtaagggtcccttccggccccccgttcgggtaccctaccggttaccgtccccgttccccgtaccccgtttccccg

SEQ ID NO: 2884 - DNA, 527 bp, Homo sapiens
  misc_feature: GYAE6OF01CVQXC.12.21.B10.1.454.CMB.1.raw
  modified_base (445)..(445): a, c, t, g, unknown or other
  misc_feature (445)..(445): n is a, c, g, or t
  modified_base (513)..(513): a, c, t, g, unknown or other
  misc_feature (513)..(513): n is a, c, g, or t
tcagatacgacgtacacgaccggtgctcgatttagtgtcgtcgcaagagaggaggggggggtcacaagaggcagcgctctcgggacgcctccaccatggcctggctctgctgctcctcactctcctcactcaggacacagggtcctgggcccagtctgccctgactcagcctgcctccgtgtctgggtctcctggacagtcgatccaccgtctcctgcacgtggaccagtaatgtattttggaaattttgacctagtctcctggtaccaacaataccccggcaaagtccccaagttaatcatttatgaggcactaagccggcctcaggtatttctgatcgcttctctggctcaaggctggcgaccgggcctccgtagacaatactcgtcgggctccgaggctgaggacgaggctcgattacactgctgctcatatggtagtttanagctacgttgggtgttcggcggtcggactaagtcgaccgtctagcgagccagctcgcccctgtcactntcgtcccgcctccg

SEQ ID NO: 2885 - DNA, 530 bp, Homo sapiens
  misc_feature: GYAE6OF01ENTMV.12.21.B10.1.454.CMB.1.raw
  modified_base (338)..(338): a, c, t, g, unknown or other
  misc_feature (338)..(338): n is a, c, g, or t
  modified_base (431)..(431): a, c, t, g, unknown or other
  misc_feature (431)..(431): n is a, c, g, or t
  modified_base (513)..(513): a, c, t, g, unknown or other
  misc_feature (513)..(513): n is a, c, g, or t
  modified_base (523)..(523): a, c, t, g, unknown or other
  misc_feature (523)..(523): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgacgtcagcctgcctccgtgtctgggtctcctggacagtcgatcaccgtctcctgcactgggaccagtaatgtattttggaaattttgacctagtctcctggtaccaacaataccccggcaaagtccccaagttaatcatttatgagggcactaagcggccctcaggagtttcngatcgcttctctggctccaaggctggcgaccgggcctccctgacaatatctgggctccaggctgaggacgaggctcaattactactgctgctnatatggaggttatagctagttgggtgttcgggcggcgggacaagtcgaccgtctaagcgacgccaaggctcgcccctcgtcnctctcgtccnccctccg

SEQ ID NO: 2886 - DNA, 842 bp, Homo sapiens
  misc_feature: GYAE6OF01DC9XB.12.21.B10.1.454.CMB.1.raw
  modified_base (314)..(314): a, c, t, g, unknown or other
  misc_feature (314)..(314): n is a, c, g, or t
tcagatacgacgtacacgaccggtgctcgatttagtgtcgtcgcaagagaggagggggggggtcacaagaggcagcgctctcgggacgcctccaccatggcctggctctgctgctcctcactctcctcactcaggacacagggtcctgggcccagtctgccctgactcagcctgcctccgtgtctgggtctcctggacagtcgatcaccgtctcctgcacgtgggaccagtaatgtatttttaggaaattttgaccttagtctctggtaccaaacaactacccggacaaacgtcccaagttaatctaattttanggaagggctaacgtaaacgccggaccctcgaaggtacgtttcctaggtacttcgctttctcgtggccttccgaaaggtccgtacggccgaacccgggtcccttcccgttaggaacctaagttaactccgttcggggccttacccgagggtccgtacggaacggggaaccggacgggtacccttacgttaactttaaccgttaaccgtcggttcccgtaaggtcccttaccgtaacgttaaggtttacggggtaacgggttttaacttaacggtaacccgtttaaccgggttttcgggggttacggttttacccgggggaccggggtacccgggggttaaaccggtaaaacggggttacgtaaccccgggttacccgttaaaacgggttacccggaaaaccggttaccccggtaaacggggtacccccttacccggggtcccccccccggtttaaccgggtacccgttaaaccccgtttcccgggtttaccccggttttaccccccccggccccgttttttacccccgg

SEQ ID NO: 2887 - DNA, 555 bp, Homo sapiens
  misc_feature: GYAE6OF01B0XK6.12.21.B10.1.454.CMB.1.raw
  modified_base (336)..(336): a, c, t, g, unknown or other
  misc_feature (336)..(336): n is a, c, g, or t
  modified_base (381)..(381): a, c, t, g, unknown or other
  misc_feature (381)..(381): n is a, c, g, or t
  modified_base (547)..(547): a, c, t, g, unknown or other
  misc_feature (547)..(547): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctgtaccaacaataccccggcaaacgtcccaagttaatctatttatgaggcactaagcggcctcgaggtagtttcngattcgcttctctggctccgaaggctggccgaccgggtcctcccngacaatatcgtgggctccgaggctggaggacgagctcattactactgctgctcattagtggtagttatgacgtagttgggtgttcgggcggacgggacaagtcgaccgtacgtaacgtcgacgacccaaggcctcgcccccgtcggtccacttcctccgttccccnccctcccg

SEQ ID NO: 2888 - DNA, 553 bp, Homo sapiens
  misc_feature: GYAE6OF01CCMSG.12.21.B10.1.454.CMB.1.raw
  modified_base (520)..(520): a, c, t, g, unknown or other
  misc_feature (520)..(520): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaactaccccggcaaacgtccccaaagttaatcatttatgagggcactaagccggccctacaggatttctgatcgcttctctcggctccaaggctcggcgacccgggcctccctagacaatatcgtagggcctccgaggtctggaggacgaggctcattactactgctgctctatagtggtagttatacgtctacgttgggtcgtcgggcgggcggaacaaggtcgaccgtctaacgcacgccaaggcnccgcccctgtcactcgtccttcccgcccttccg

SEQ ID NO: 2889 - DNA, 550 bp, Homo sapiens
  misc_feature: GYAE6OF01DGBIQ.12.21.B10.1.454.CMB.1.raw
  modified_base (312)..(312): a, c, t, g, unknown or other
  misc_feature (312)..(312): n is a, c, g, or t
  modified_base (455)..(455): a, c, t, g, unknown or other
  misc_feature (455)..(455): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaactacccccggacaaacgtccccaaagttaatcattttangaggcactaagccggccctcaggtatttctgatcgtcttctctggctccaaggctggcgaccgggcctcccgtgacaatactcgtgggctccgaggctggaggacgaggctcattactactgctgctcattagtggtagttanagctacgttgggtcgttcgggcggacgggaccaaggtcgaccgtctagtcacgcccaggcctcgcccctcggtcactctcgttccccgcctcccg

SEQ ID NO: 2890 - DNA, 584 bp, Homo sapiens
  misc_feature: GYAE6OF01CQMQU.12.21.B10.1.454.CMB.1.raw
  modified_base (216)..(216): a, c, t, g, unknown or other
  misc_feature (216)..(216): n is a, c, g, or t
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctcgtgtctggtctcctggacagtcgatcacctatttccngcaaccggaacatagtgacgttgtcgttatactttgctctgtacaacngcaccaggacaacgcccccaactcctgatttangtacgtcacttattcggtcctcaggtaatttctaatcgtcttctctcggttaccaagtctcggacaacgaccggtcctaccctcgaccctagtcctcgtcggggtccaggctaggacggacgaggtctagtatttacgttactgactagttcatatacagactacttccacttcgtcggttggttcgttcgggtcggtacggaccaagctacgaccgttacgtaacgtccacgtacccgaacggtcctccgtccccgtcggtacaccgttctcccgttccctacccc

SEQ ID NO: 2891 - DNA, 681 bp, Homo sapiens
  misc_feature: GYAE6OF01CMENJ.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgccctccgtgtcgtgggtctcctggacagtcgatcaccgtctcctgcacgtgggaccagtaatgtattttaggaaattttgactagtctcctggtacaacaactacccggacaaacgtccccaagttaatctaatttatggaggtcacgtaaggccgccctagacggtagtttcagtactcgtctttccgtcgtcggtctaccgaagggccgtcgggaccggacccgggcccttacccgtagaacctaatacgtccgtcgggtcctccgaggcgtcggacggacgacggcttacgtacttacctacgtcgacttgcctcgtagttacggtgggtaagttacgttacgaccggttaggtttcggggttaggttccgggaccggggtacggtaacgtaaacggtccgtaacccgttccgttaaacgtccgtaaccggaccccgaaggtcccgtacccgtccccgtacggtaccctacgttcccttccgttaccccctcccgttaccccg

SEQ ID NO: 2892 - DNA, 753 bp, Homo sapiens
  misc_feature: GYAE6OF01DHG7W.12.21.B10.1.454.CMB.1.raw
  modified_base (324)..(324): a, c, t, g, unknown or other
  misc_feature (324)..(324): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgccctccgtgtcgtgggtctccgtggactagtcgatccaccgtctcctgcacgtgggacctagtaatgtattttaggaaattttgaccttagtctccgtaggtaccaactaactacccggacaaacgtccccaagttaactctaatttanaggacggctaacgtaacggccggtaccctagacggtagtttctagactcgtcttctcgtcggcctaccgaaggtcgtcgggccggtaccccgggtccctacccgtaggaacctaagttcgtaccggtcgggtcctaccgagggtccctagggaacgggtacggacgggtccttaacgtaacgtttaccgtacgtcgtccgtagtcccttatagttaacggttagggtaaggtttacgtacggtaccgttacgggtttgggggttacggttccggggaccggggtaccgggaaaccgtaacgggtccggtaacccgttaccgtaaacggtccgaacccggtacccggaaccgggtccctacccgggtaccccccgttacggttaccgacccttcccggttccccggttcccccgccccttttaccccggg

SEQ ID NO: 2893 - DNA, 704 bp, Homo sapiens
  misc_feature: GYAE6OF01CJ7S2.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctggctctgctgctcctcactctcctcactcaggacacacgggtcctgggcccagtctcgccctgactcagcctgcctccgtgtctgggtcctccgtggacagtcgatcaccgtctcctgcacgtggacctagtaatgttagtttaggtaattttcgactatctcgtacgtaccaacaactacccgacaaacgtaccctaagttactctaatttacgaggaggactaacgtaacgccggacctagtacggtacgtttctgtactcgtcttctcgtcgtacctaccgaacggtcgtacggcccggtaaccgggtcccttacccgtacgtaaactaacgttacgtccggtcggtaccgtaccgaacggtcgtaggaacgggtccgtaaggtcctacgttaacttaccgttaacgtccgtactgtctaactacgttaaggtcggttaaagttcgtaggaccgtttacggttcgggtcggttaccggggacggtacgggaaccttaacggtaccgtaaccgtacgttaacaccggtaccgtacgaccggtccgtaccccggtccccgtacgtcctaccttccgttccctacccgcccctttacccgg

SEQ ID NO: 2894 - DNA, 619 bp, Homo sapiens
  misc_feature: GYAE6OF01DHRNX.12.21.B10.1.454.CMB.1.raw
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
  modified_base (433)..(433): a, c, t, g, unknown or other
  misc_feature (433)..(433): n is a, c, g, or t
  modified_base (476)..(476): a, c, t, g, unknown or other
  misc_feature (476)..(476): n is a, c, g, or t
tcagatacgacgtacacgaccggtgctcgatttagtgtcgtcgcaagagaggaggggggggggtcacaagaggcagcgctctcgggacgcctccaccatggcctgggctctgctgctcctcactctcctcactcaggacacagggtcctgggcccagtctgccctgactcagcctgcctcgtgtctgggtctccgtggacagtcgatcaccgtctcctgcacgtgggaccagtaatgtattttaggaaattttgacctagtctctgtaccaacaactacccganaaacgtcccaagttatctatttangaggcactaagccggcctgaggtatttctgactcgtcttctctggcctaccgaaggtcgtcgggccgtacccgggtccctccgtagactaatacgtcgtcgggacctcgaggtctggacggacgnggtctactaacttactactgctgctacaattgtaggtagttanacgtcgttacggttggggtcgttcgggacggtaccggtacgaaggtccgtaccgttacgtaagtccgaacgaccccggaaggtccctacccggtcccccgtcgtacctaccgttcccgttcccgttccccgtccccttaccgg

SEQ ID NO: 2895 - DNA, 593 bp, Homo sapiens
  misc_feature: GYAE6OF01DRJFY.12.21.B10.1.454.CMB.1.raw
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (417)..(417): a, c, t, g, unknown or other
  misc_feature (417)..(417): n is a, c, g, or t
  modified_base (565)..(565): a, c, t, g, unknown or other
  misc_feature (565)..(565): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacaggtcctgggcccagtctgccctgactcagcctgcctcgtgtctgggtctcctggacagtcgatccaccgtctcctagcacgtgggaccagtaatgtattttaggaaattttgactagtctcgtaggtaccaacaacgtaccccggacaaacgtcccaagtttaacnctatttagtgacgggacacgtaagccggccctanaggtatttcgngatcgtcttcnctgactcgaggctggccgaccggcctccgagactactctgtcggctcgaggtcnggaagacggacggacggtatttatacgtgttacgcttcacgtagtcgggtacggttactacgtcgttaacgtttcgagtttccgtacgttacggtcgggacggaggtaccacggtctccggaccgttcgcggtcacggccacggtccnccgtccctcggtcacttccgtcgtcccc

SEQ ID NO: 2896 - DNA, 695 bp, Homo sapiens
  misc_feature: GYAE6OF01AD4E7.12.21.B10.1.454.CMB.1.raw
tcagatacgacgtacacgaccggtgctcgatttagtgtcgtcgcaagagaggagggggggggtcacaagaggcagctctctcgggacgcctccaccatggcctgggctctgctgctcctcactctcctcactcaggacacagggtcctgggcccagtctgccctgactcagcctgcctccgtgtctgggtctcctggacagtcgatcaccgtctctgcactgggaccagtaatgtattttaggaaattttgacctagtctcctggtaccaacaactaccccggacaaacgtaccccaagttaatctatttagtgagggacacgtaacgccggtccctacgaggtacgtttctgactcgtcttctctggcctaccgaaggcgtcggccggacccgggtcctccgtacggacaattactctaggtcgccttacgaggcgtaggacggacggtaggtctacgtaactttaccgtacgtcgtacctgtaccttcgtagttagtagggtaaggtttataacgtccgttacgggtttcggggttcggttaccggggaccgggtaccgggtaaaccggtaaagggtccggtaacccggttccgtaaacggttccgaaccggtaccccggaacggtcccgttcccggtccccccgttacggtaccctaccgttcccggtttcccgttcccccggttccccccg

SEQ ID NO: 2897 - DNA, 707 bp, Homo sapiens
  misc_feature: GYAE6OF01DDHNI.12.21.B10.1.454.CMB.1.raw
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
tcagatacgacgtacacgaccggtgctcgatttagtgtcgtcgcaagagagggaggggggggtcacaagaggcagcgctcgtcgggacgcctccaccatggcctggctctgctgcctcctcactctcctcactcaggacacgagggtcctggcccagtctcgccctgactcagcctgcctcgtgtcgtgggtcctccgtggacagtcgactccaccgtctcctgcacgtggacctagtaatgtatttaggaatttgacctagtctcgtagtaaccaanaacgtacccgacaaacgtcccaagttaanctatttanaggaggacaacgtaagccggaccctagaggttagtttctgtatccgtcttctcgtgcctaccgaaggcgtcggaccggtacccgggtcctcccgtagaacctatacgtcgtcggctcgaagcgtacggacggtacgacggtctactaatttaacctacgtcgtctacggtctacgtaagtttagtacgggttaagttagttaacgtaccgttacggttttgggggtcggtttccgggggaccgggttaccgggtaaccgtaaacggttccggtaacccgtaccgttaacggaccgtaaccgaccccgtaacgggtcccgttaccccggtaccccgtcgggttaacccttaccgtttcccggttaccccggttccccgtaccccgttaccccg

SEQ ID NO: 2898 - DNA, 755 bp, Homo sapiens
  misc_feature: GYAE6OF01DNTJ7.12.21.B10.1.454.CMB.1.raw
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtcgggaccagtaatgtattttaggtaatttgactagtctcctagtaccaacaactacccgacaaactacccaagttaactctatttangaggacacgtaacgcgtcctagaggtatttcngatcgtcttctctcgctaccgaaggcgtcggccgtacccgggtcctccgtagaactaactacgtcggtacggtccgtaccgtaggtccgtagggaacgggacgtacggtctactaacgtttacctacgtcgtcgtcgtactactaagttaggtagggtaagttaactcggtacgttacggtttaggggttccgggttaccggggaccgggtaaccgggtaaccgtaaaagggttcccgggtaaacccgttacccggttaaaacggttaccccggtaaacccgggacccccggttaaaaccggtccccgtttacccccgggtaccccccccggtttacgggtttaccccgtaaaccccgtttccccggttttaccccccggttaacccccccgtacccccgttttaacccccgg

SEQ ID NO: 2899 - DNA, 645 bp, Homo sapiens
  misc_feature: GYAE6OF01CNRF8.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttggacttataaccttgtctctggtaccaacaacaccaggacaaacgccccaaactcatgatttatgaggcactaagccgccctgaggtagtttctgacttcgcttctcgtcggccttaccgaaggcctacgggacctaaaccgaccggtcccttacccgtaggaacctaacttccgtccgtcggggtccctaccggaggccttagggaacgggaccgaggcttaggtaatttacgtttaccgtgtccttaggtccttacaagttagtcggacgtaagggttacgtcggtaccttaccgtttcggaccttaaccgttacggttccggggacgggtaacgggtaacccaaggtcccgtacggtaccccgttccgtacggttacccaacggtccccgaaagggtccccg

SEQ ID NO: 2900 - DNA, 782 bp, Homo sapiens
  misc_feature: GYAE6OF01DA9B9.12.21.B10.1.454.CMB.1.raw
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtcgtgggtctccgtggacagtcgatccaccgtctcctgcacgtggactagtatgtatttagtaatttgacctatctccgtacgtaccaactaactacccganaaccgtacccaagttactctatttanaggacggacaacgtacgccggtaccctagtagggtacttttacgagtacttccgtcctttcgttacgtcggtaccctaaccggaacgggtcccggtacgggaccccgggtaccccgggtaccccttacccgtaacgggtaacctaaacggtttaccggttccggttaaccggggtccctaaccccgggtaggtccgtaacgggaacgggaaccggtacggtaccttacgttaactttaccgccgttacgtccgttacgtacttacgtaaggtttacggtagggtttaacggtttacgaaccggttacggttacggggttttggggttaccggtccggggaccgggtaacggtaacgtaacggttcccgtaaccgtaccgtaacggaccgacggtacccgtacggtcccgtaccccggtcccgttacgtacccttacgttcccgttaccccttaccccgtccccgtttaccg

SEQ ID NO: 2901 - DNA, 713 bp, Homo sapiens
  misc_feature: GYAE6OF01C7TL9.12.21.B10.1.454.CMB.1.raw
tcagatacgacgtacacgaccggtgctcgatttagtgtcgtcgcaagagaggaggggggggtcacaagaggcagcgctctcgggacgcctccaccatggcctgggctctgctgctcctcactctcctcactcaggacacagggtcctgggcccagtctgccctgactcagcctgcctccgtgtcgtgggtctccgtggacagtcgatccaccgtctcctgcacgtggaccaggtaatgtattttagaaattttgaccttagtcctctaggtaccaacaacgtacccggctaaacgtccccaaagttaatctaattttataggacggcctaacgtaacgccggtccctacgaggttacgtttctagattccgctttccgtacttcgggccttaccgaagggtcgtcgggtcccggaaccccgggtccctcccgtagaacattactcgttcgggaccgttaccgagggactgggacgggtaaccgacggtctacgttaacttaacctacgttacgtccttggaccttactagtaacgttgggtaagtttaacaggtaccttacgggtttgggtcggttcgggaccgggtaccgggtaacgtaagggtaccgtccggtaacccgtaagtaccgaccgtaacccggaacggtcccgtaccggccccccgtttacggtacccacctttcccgtcccgtttccccgccccgtttccccg

SEQ ID NO: 2902 - DNA, 699 bp, Homo sapiens
  misc_feature: GYAE6OF01CXJVY.12.21.B10.1.454.CMB.1.raw
  modified_base (333)..(333): a, c, t, g, unknown or other
  misc_feature (333)..(333): n is a, c, g, or t
tcagatacgacgtacacgaccggtgctcgatttagtgtcgtcgcaagagaggaggggggggtcacaagaggcagcgctctcgggacgcctccaccatggcctgggctctgctgctcctcactctcctcactcaggacacagggtcctgggcccagtctgccctgactcagcctgcctccgtgtctggtctctggacagtcatcaccgtctctgcactggaccagtaatgtattttggaaattttgacctagtctctgtacaacaactacccggactaaacgtcccaagttaatctatttacgtgaggcactaagccgcctagaggtagtttcngtatcgcttctctggctacgaaggtctggaccgacccgggtcctccgtagaactaatacttcgtcgggaccttccgaggtctaggacggacgtacggctacgtaacgtttacctaatcggtactcggtacctactaagtaaacggttgggtaacgtttaactacgggtaccgttacggttttacgggggtcgggtttaccggggaccggggttaaccggggtaaaccgtaaaagggttccggtaacccccggttaccgttaaacggtccgaaccgggtaaccccgaaacgggtcccttacccggtaccccccgttagggtcccctaaccgtttcccgtcccggtttccccccgcccgtttaccccg

SEQ ID NO: 2903 - DNA, 811 bp, Homo sapiens
  misc_feature: GYAE6OF01A00WJ.12.21.B10.1.454.CMB.1.raw
  modified_base (312)..(312): a, c, t, g, unknown or other
  misc_feature (312)..(312): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctacctccgtgtctgggtctcctggacagtcgatcaccgtctcctgcacgtgggaccagtaatgtattttggaaattttgactagtctctggtaccaacaactaccccggacaaacgtccccaaagttaatctaatttanggagggacaacgtaaggccggaccctcgaggtcgttttctgactccgtcttctcgtcggcctaccgaagggcctcgggaccggtacccggggtccccttaccccgtagaaccgtaaacttaacgttccggtacggggtccctacccgtaagggtccgttagggaacgggtaaccgggtacgggtccttaccgtaaacttttaacccgtaacgttcgtcccgttacggtaccttaccgtaaagttacggttaacggggttaacgggttttaactaacggttccgttaacgggttttcggggggttaccggtttcccgggggaccggggttaccggggtaaacccgtaaagggttcccggtaacccgggttaccgttaaacgtccgtaacccgggaccccgtaagggtacccgttccccgggtaccccccgttacgggttaccctaaccgttcccgttaccccgggtttacccccctaccccggtttccccgttaacccgg

SEQ ID NO: 2904 - DNA, 708 bp, Homo sapiens
  misc_feature: GYAE6OF01DFZDK.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctggctctgctgctcctcactctcctcactcaggacacgagggtccgcgggcccagtcctcgccctgactcagcctcgcctccgtgtcgtcggtctcgtggacagtcgactccacctgtcctcctgacctaacgtacggaaccagacgtagtcgtacggttggttacgttaataacgttagtcgttcctaccgttaggtaaacccacgacgacccaccgaggacctaaccggaacccctacccctaaaatcgttaagtttagtttattttagaacgtctaacgaacgtttaccgtcccggtaccgtaggttacggtttcacgttacgtcgttctttacgccgtcgtactactaagttctaaccgtacctaacccggtccgtccctacccagtaacctcgttaccgtccgtccgggtaccttaccggaggtaacggtacgggacggacggttacggtacttagttaagttttaagtcgttagaacctacgtccttaactaagtaaccaacggaagtccaacgactaccgtccctacgttttccgtagttacggacgtacggacgttaccacggttccaccggtaccacgacgccaaccgcccgtaacc

SEQ ID NO: 2905 - DNA, 761 bp, Homo sapiens
  misc_feature: GYAE6OF01DHQV3.12.21.B10.1.454.CMB.1.raw
  modified_base (201)..(201): a, c, t, g, unknown or other
  misc_feature (201)..(201): n is a, c, g, or t
tcagatacgacgtacacgaccggtgctcgatttagtgtcgtcgcaagagaggagggggggggtcacaagaggcagcgctctcgggacgcctccaccatggcctggctctgctgctcctcactctcctcactcaggacacgagggtcctgggcccagtctcgccctgactcagcctgcctcgtgtcgtggtctcgtaggacngtcatccaccgtctctgcacgtggactagtatgtatttaggaaattttgaccttagtcctcgtagtaccaacaacgtacccggacaaaccgtcccaaagttactactaatttacgtggacggactacgtaacgccggtaccctgacggtacgtttctggtaactccggtctttccgttcgtcggacctaccgaacgggtccgtacgggtacccggacccgggtccctccgtaggaacctaagtacttccggcgggtacctccgtaaggtcgtagggaacgggacgtacgggtcccttaacgtaagttacccgttaacgtcggttacccttcggacctttacgaaagtttacggttagggttaacggttaactacggttaccgtacggggttttcgggttccgggttaccggggacgggtaccgggtaaaccgtaacggttaccggtacccgtaccgttaacgaacccgtaccggtacccgtaacgggtcccgaccccgttacccccggttacgtacctacccgttacccggttccccgttccccgttcccctttacccgg

SEQ ID NO: 2906 - DNA, 720 bp, Homo sapiens
  misc_feature: GYAE6OF01BLVOA.12.21.B10.1.454.CMB.1.raw
  modified_base (282)..(282): a, c, t, g, unknown or other
  misc_feature (282)..(282): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatccaccgtctcctgcacgtgggaccagtaatgtattttaggaatttcgactagtctctgtaccaacactacccgganaaacgtcccaagttactctatttagtagaggactacgtaagcccggtaccctacgaggtacgtttcgtagtattcgtctttcgcgttcggcctaccgaaggtcgtacgggacccggtacccgggccctccgtagaaccctaattacgtccggtacgggtaccctaccggtaggtccgtaagggaaccgggacgacgggtacctaccgttacgtttaaccacggttcgccttacgtcctacgtagtaacggtaggttaacggtttataacgtacggttacggtttgggggtacgtttccggggcggtaaccgggtaaccgtaaggtcccggtaaccgttacgtaaacggtcccgaacgaccccggaacggtccccgttacccggccccccgttaggtcccttacccgttacccgttccctacccctccccggttacccc

SEQ ID NO: 2907 - DNA, 841 bp, Homo sapiens
  misc_feature: GYAE6OF01DWOHV.12.21.B10.1.454.CMB.1.raw
  modified_base (311)..(311): a, c, t, g, unknown or other
  misc_feature (311)..(311): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacgagggtcctgggcccagtctgccctgactcacgcctgcctcgtgtcgtgggtctcctggacagtcgatccaccgtctctgcacgtggacagtatgtatttggaatttgactagtctcctgtaaccaactaactaccccgacaaacgtccctaaagttaactctaatttagnggacggacaacgtaacggccggaccctagtaggtacgttttcagtacttccgtctttcgtcgtcggtcctaccgaacggtcgtaccgggtacccggacccgggtcccttcccgtacgtaacctaaacgttacgtcgttacgggccttacccggacggtccggtacgggaacgggtaacccgggtacggtacccgttacgtaacgtttaaccgttaccggtacgtcggttaccgtccgttaactaacggttaaggttacgggtttaacggtttaagtaaccggtaccggtttaacgggtttcggggggtttaccgggtttcccggggggtaaccggggtaacccggggtaaacccggttaaacgggttcccggttaaacccggttacccgttaaacgggttacccgaacccgggtaccccggaaacgggttcccccggtacccccggttacccccccggtttacgggttacccccttacccgtttccccgtttacccccgtttcccccccgttacccccgtttacccccgg

SEQ ID NO: 2908 - DNA, 776 bp, Homo sapiens
  misc_feature: GYAE6OF01CTBKS.12.21.B10.1.454.CMB.1.raw
  modified_base (314)..(314): a, c, t, g, unknown or other
  misc_feature (314)..(314): n is a, c, g, or t
tcagatacgacgtacacgaccggtgctcgatttagtgtcgtcgcaagagaggagggggggggtcacaagaggcagcgctctcgggacgcctccaccatggcctggctctgctgctcctcactctcctcactcaggaccacgagggtcctgggcccagtctgccctgactcagcctgcctcgtgtctgggtctccgtggacagtcgatcaccgtctcctgcacgtgggacctagtaatgtattttggaaattttgacctagtctcctggtaccaacaactaccccggcaaacgtccccaagttaactcattttanggagggacacgtaagccggccctcgaggtcgtttactggatcggctttcgtcgtacggtctaccgaagggtcttcgggaccggtacccggggtccctaccccggttaggaacctaaaattcgtccgttcggggaccttcccgaagggtcctaggtacgggacgtacgggtccttactaactttaacgtccgtgcctttacggccttacgtagttacggttaggggtacggtttaacgtacggacggttaaccgggttttgggggttacggtttaccgggggaccggggtaacccgggggttaaccgtaaaaggggttcccgggtaaccccggttaaccggttaaacggtacccgtaaccgggtaccccgtaaacgggtccccttaccccgggtcccccccgtttcgggtaccctaacccgtttcccgtttaccccggttcccccttaaccccgtttccccgg

SEQ ID NO: 2909 - DNA, 676 bp, Homo sapiens
  misc_feature: GYAE6OF01EE8EY.12.21.B10.1.454.CMB.1.raw
  modified_base (200)..(200): a, c, t, g, unknown or other
  misc_feature (200)..(200): n is a, c, g, or t
  modified_base (318)..(318): a, c, t, g, unknown or other
  misc_feature (318)..(318): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacngtcgatccaccgtctcctgcacgtgggaccagtaatgtattttggtaaattttcgactagtctcgtcggtaccaacaactaccccggacaaacgtcccctaagttaactctaatttanggaagggccaacgtaacgccggtccctcgtaggtagtttcgtgactcgtcttctcgtgctccgaaggcgtcggaccgacccgggtccctccgtagactatacgtcgtcgggtcctaccgaggtccgtaggacgggtacgacgggtccttctaacgttacctactcgtcgttgccttacgtaattcggttagggttaacgttataggtccgttaacgggtttggggttcggttcggggaccgggtacgggtaaccgtaaaggttccgtaaccggtcgtaacgtaccgacggacccgacggtccctcccggtccccgttcggtcctaccgttccgttcccgttccccgtccccttacccg

SEQ ID NO: 2910 - DNA, 673 bp, Homo sapiens
  misc_feature: GYAE6OF01DDIO8.12.21.B10.1.454.CMB.1.raw
  modified_base (286)..(286): a, c, t, g, unknown or other
  misc_feature (286)..(286): n is a, c, g, or t
  modified_base (661)..(661): a, c, t, g, unknown or other
  misc_feature (661)..(661): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgccctccgtgtctgggtctccgtggacagtcgatccaccgtctcctgcacgtggaccagtatgtatttaggaaattttgacctagtctacgtgtaccaacaactacccgganaaacgtcccaagttactctattactggagctaactaacgccgccctagaggtcgtttacaggtacttcgctttccgtcgttcggacctaccgaagggtcctacggggcccgacccggtccctccctaggaacctaagttcgtccggtgggtccctcggaacgtcgtacggtacgggacgtacgccttagtaactaccgtactggtcctagtcctacagtacggtaggtaagtttatacggaccgttaggttcgggtcggtttccggggacgggtaccggtaaccaacggttcgaccgttaccgtaacgacgtaccggacccgaacgtccgtaccccgtcccgtcgtacccgtaccttcccttcccggttcccccnccgtttaccccg

SEQ ID NO: 2911 - DNA, 812 bp, Homo sapiens
  misc_feature: GYAE6OF01B05OY.12.21.B10.1.454.CMB.1.raw
  modified_base (312)..(312): a, c, t, g, unknown or other
  misc_feature (312)..(312): n is a, c, g, or t
tcagatacgacgtacacgaccggtgctcgatttagtgtcgtcgcaagagaggaggggggggtcacaagaggcagcgctctcgggacgcctccaccatggcctgggctctgctgctcctcactctcctcactcaggacacagggtcctgggcccagtctgccctgactcagcctgcctcgtgtctgggtctcctggacagtcgatcaccgtctcctgcacgtgggacctagtaatgtattttggaaattttgacctagtctcctggtaccaacaactacccggacaaacgtcccaagtttaactctaatttanaggtacgggactaaccgtaaacgccggtacccttacggttacgggggttttacctttaacgtcgttcctttccgttccgttcgggtaccttaccggtacgttccgttacgggaccctaaaccgtacccgggtccccttaccccgtaagtaaccctaacgttccttcgtacgggtccttacccgagggtcctagggacgggacgtacgggaccggttaatttacgttacgttgtgtactacaagttacgtcgggtacggttagtacgttaccgtacttttacggaacgtttcggtttaaccgttacggttaccggggtacggggtaacccggtaaccggtaaacggttcccggttaacggtaccccgggttccggttaccggggtacccgtaaccggaacccccggtaaacgggcccccgtttacccgggtacccccccgtttaccgggttacctaccccgtttcccggtttccccgggttacccccccttaaccccccgg

SEQ ID NO: 2912 - DNA, 713 bp, Homo sapiens
  misc_feature: GYAE6OF01B5RAQ.12.21.B10.1.454.CMB.1.raw
  modified_base (311)..(311): a, c, t, g, unknown or other
  misc_feature (311)..(311): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctccgtggacagtcgatccaccgtctcctgcacgtgggaccagtaatgtattttaggaattttgactagtctctagtaccaacaacgtacccgacaaacgtcccaagttaactctatttanggaggactaacgtaacggccggccctacgtagggtactttctgtactccgtcttcgtcgtcggtctaccgaaggtcgtcggaccggacccggtcctccgtacgactaactacgtcgtcgggtcctaccgacggtcgtacggaacggtacggacggtcccgttactaacgtttacgtaaccgttcgtacgtcgtactacgtaagttaggtagggttaggtttaacgtcggttacgtacgggtttacggggttcggtaccggggtaccgggtacggtaaccgtaacgggtaccgtacccggttaccgtaaacgtccggaaccgaccggtaccggtcccttcccgggtccccccgttacgttcccgtacctcccgttaccccgttccccctacccgtttaccccg

SEQ ID NO: 2913 - DNA, 647 bp, Homo sapiens
  misc_feature: GYAE6OF01BNLOD.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtgggaccagtaatgtattttggaaattttgacctagtctcctggtaccaacaactaccccggacaaacgtccccaaagttaatctatttatgagggcactaagccggcctcgtagggtttctatcgtcttctctggctcgagtctggcaacgacggccctccctgaactactctcgtgggcctccgaggtctggacggacgagggcggtaatttagttacgtgtgcagctagtgggactgacacgtccgtagtaacgttcgggtaccggttacggttccggggaccgggtaacgggaaccaaggtccgtacggaccccggttaccgtacgggtcccgaacggaccccggtaagggtccccgttacccggccccccgttacgggttacccaccgtttcccgttcccgtttccccccgtaacccccg

SEQ ID NO: 2914 - DNA, 768 bp, Homo sapiens
  misc_feature: GYAE6OF01AFSVG.12.21.B10.1.454.CMB.1.raw
  modified_base (309)..(309): a, c, t, g, unknown or other
  misc_feature (309)..(309): n is a, c, g, or t
tcagatacgacgtacacgaccggtgctcgatttagtgtcgtcgcaagagtaggtaggggggggtcacaagaggcagcgctctcggacgcctccaccactggcctggctctgctgctcctcactctcctcactcaggacacgaggtcctgggccctagttctgccctgactcagcctgcctcgtgtcgtggtcctcgtggacagtcgatcaccgtctcctgcacgtggacagtatgtattttaggaattttgacctgtctccgtgtaccaacactacccggactaaacgtccctaagttactctattacnggaggaccacgtaacgccggcccgtacgaggtagttcgtgtactccgtcttaccgtacgtacgacgtacgaaaggtcgtacgggaccggtacccggtccctaccgtacgaactaagtacgtacgtcgggtacctaccgaggtcgtacggacgggaacgacggacctacgtaacgttaacaccttacggtcctacgtcttacgaacttaaggttacgggttaagtttaacggttaaccgtacgttacggtttacgggggtacgggtttaccggggacccggggtaacccggggaacgttaaaaccgggttcggtaccccgtttaaacccggttaaaggttccccggtaaccgtaaccccgggtaaccgggttcccgtacccggtaccccccgtttaccggttaaccttccccgtttaccccggttttcccgtttaccccccgttccccgtttacccccgg

SEQ ID NO: 2915 - DNA, 805 bp, Homo sapiens
  misc_feature: GYAE6OF01B2ZYM.12.21.B10.1.454.CMB.1.raw
  modified_base (524)..(524): a, c, t, g, unknown or other
  misc_feature (524)..(524): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctccgtggacagtcgactcaccgtctctgcacgtggactagtatgtatttaggtaatttgacctagtctcgtaggtaaccaactaacgtaccccggactaaaccggtacccctaagtttaactactaatttacgtacggaacgggtacctaacgtaaaccggcccggtccctacggtaaggttacgtttctaggacttccgtctttccgtcgtcggactaccgaagggtccgtacggcccggtacccgggtccctacccgtaggaacctaagttacgtccggtgggtaccctcgaggtcgtaggaacgggacgcggtactacgtaattaccgtntacgtctatcgtactaagttacggttagggttaacgttaacgttaccgtaggtttaaccgggttgggggttttacccgggaccggggtaccgggaaaccggggttaaccgtaaagggttacccggttaaccccggtaagtttaaaccggggcccgaaacccgggttaaccccggaaccgggtttcccccggttacccccggtaccccccgggtttacccggttaaccgttcccctttaacccccgggttccccttcccccccggtttccccgttaccccgg

SEQ ID NO: 2916 - DNA, 704 bp, Homo sapiens
  misc_feature: GYAE6OF01BXG2N.12.21.B10.1.454.CMB.1.raw
  modified_base (286)..(286): a, c, t, g, unknown or other
  misc_feature (286)..(286): n is a, c, g, or t
  modified_base (310)..(310): a, c, t, g, unknown or other
  misc_feature (310)..(310): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacgagggtcctgggcccagtctgccctgactcagcctgcctccgtgtctgggtctccgtggacagtcgatcaccgtctcctgcacgtgggacctagtaatgtattttaggaaattttgacctagtctctggtaccaacactacccggnaaacgtcccaagttatctatttangaggcactagcgcctgaggtatttcngatcgtcttcncgtgctacgaaggctaggccgacccgggcctccgtagaactaatacgtcgtcgggctcgaggtcgtaggacggacgtacggcttaacgtattacgtacgtcgtcgtcgtacctacgtaagttaggttacgggtaacggtttactaacggttccgttaacgggttttgggggttaccgggtttacccggggaaccgggggtaccgggtaaacccgtaaacgggttcccgggtaaacccgttacccgttaaacggcccgaaaccgggtaccccgaaacgggttcccgtacccggttaccccccgttacgggttaccctaccgttcccggttaacccttccccgttacccctttaaccgg

SEQ ID NO: 2917 - DNA, 751 bp, Homo sapiens
  misc_feature: GYAE6OF01CH6V4.12.21.B10.1.454.CMB.1.raw
  modified_base (224)..(224): a, c, t, g, unknown or other
  misc_feature (224)..(224): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacactacgggtcctgggcccagtctcgccctgactcagcctgcctccgtgtcgtggtctccgtggtacagtcgactccaccgtctccngtacacgtggactagtaatgtaagtttagaattttgacctagtcctcgtacgtaaccaacaacctacccggacaaactacccgtaaagttactactagttacgaggtacggtacaacgtaacggtccggtccctaggtaacggttacgtttctaggtacttcgtctttccgtacgttcggtacctaaccggtaacggtccgtacgggacccggtaccggtcccgtccgtaccgaacctccggtcggttaccgtcggggtaccgtagtcggtaacggtaggggaacgtacggtacgttagtttacttaggttaccgtaggtactaccggttaacaacgtaactaaccgaacgtaccttaaccttccgtacttccggttacggtcggggttacgtttccgggacgggttaccgggacctaagggccttacggacccgtttacgtaacggtccgaaccggccgtacgggccccgttccgaccccgttcccgtcgttaacccggttcccttcccgtccccgtttacccccg

SEQ ID NO: 2918 - DNA, 646 bp, Homo sapiens
  misc_feature: GYAE6OF01B6AOI.12.21.B10.1.454.CMB.1.raw
  modified_base (495)..(495): a, c, t, g, unknown or other
  misc_feature (495)..(495): n is a, c, g, or t
tcagatacgacgtacacgaccggtgctcgatttagtgtcgtcgcaagagaggaggggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaaccaacaactaccccggacaaacgtaccccaagttaactctaatttatggaagggcaacgtaacggccggaccctcgaggtacgtttctgactcgtcttctctggctaccgaaggctggccggacccgggcctccctagacaattactcgtcggtacctccgacgggtctagggacggacggacggtctactaacttactactcgcttgctacattagtggtagttanagacgttacgttggggttcgtacgggccgggtacgggaaccgtaaggtcggtacccgttaccgtaaggtacccgacggacccgaacggtcctccccggtacccccgttcggtacctaccgttccgttccgttcccccgtccccgttacccg

SEQ ID NO: 2919 - DNA, 862 bp, Homo sapiens
  misc_feature: GYAE6OF01EGVD5.12.21.B10.1.454.CMB.1.raw
tcagatacgacgtacacgaccggtgctcgatttagtgtcgtcgcaagagaggaggggggggggtcacaagaggcagcgctctcgggacgcctccaccatggcctgggctctgctgctcctcactctcctcactcaggacacgagggtcctgggcccagtctcgccctgactcacgcctgcctccgtgtcgtgggtctccgtggacagtcgatccaccgtctcctgcacgtcggacagtatgtagtttaggtaaatttcgaccttagtcctaccgtacgtaaccaaacaaccgtaccccggaactaaaccgtacccctaaagttaactctaatttacgaggaacgggtacctaacggtaacggcccggtaccctaggtagggttacttttaccgaggtacgttccggttcctttccgtccgtcgggtcccttaccgggtacgtccggtacggtacccaaacccggtcccgttccccgtaccgtaacggaacctttaacttcccgtacgggtcccggtaccgtaccccggtaggtaccgtaacggggaacggtacgggaacgggttacgttaactttaacggttaccgttggttaacccgtcttaagtacgtttacggtacggggtacgggttaacgtaccgtacgtttaactttaccggtagttccggtttaaccggttacgggtcccgggtaccggggaaccggtaacccgtacggttcccggttaaccggtaccccggggtttacggtacccgggtaaccggtaacccggggacccccgtaacggggttcccccccgttaccccgggaccccccgtttaccgggtaccctttacccccggttcccggtttacccccccggg

SEQ ID NO: 2920 - DNA, 971 bp, Homo sapiens
  misc_feature: GYAE6OF01E0AXM.12.21.B10.1.454.CMB.1.raw
  modified_base (220)..(220): a, c, t, g, unknown or other
  misc_feature (220)..(220): n is a, c, g, or t
tcagatacgacgtacacgaccggtgctcgatttagtgtcgtcgcaagagaggagggggggggtcacaagaggcagcgctctcgggacgcctccaccgatggcctgggctctgctgctcctcaccctctcactcgaggcacgagggtcctggcccaatctgccctgactcagcctgcctccgtgtctgggtctcgtggacagtcgatccaacctatttccncgaccaaccgggtaaacccaagttacggtggtaaccggttttcggtacgtttaacttaaccgtttttggcccttaccgttaggttaaccaaaaaccggtcggtacccaaacccgacgggtaaccaaaacccggtacccccccctaaacggttccccgttaaggtacgtttttaaccggtacgggtaacgggttaccctaaaccgtttaacgtttcccggggttaccccttaagggtaaccgggtttaaacttttaccgttaaaaccgttcccgggtttaaccttttacccgtccggtttacccggtttaccgtaaaacggtttccgtttaacggggacctaaaacccggtacccgggtaccccttaccctaacgggtaccctaacgtttacgttccgggtacggggtacccgtaagggtacccgttaagggaccgggaaccggtaggtaccctttaggtaaacgttttaacgtcggtacgtacgtaacggttaacctaggtaacctaacgtaacggtaccctaccgtttaaccgacgtttccttaacgggttcggttacgggttcccggtacgggtaaccggtaccgtaaccgttacggtaacccgggttacccgttaaaaccttaacggggtaacctaacccgggtacccgttaaacgggggtcccttaccccggggcccccggtttacgggtacccttacccgtttaccgggcccccgtttttaacccccgaaacccccgttttcccgg

SEQ ID NO: 2921 - DNA, 693 bp, Homo sapiens
  misc_feature: GYAE6OF01C1LHF.12.21.B10.1.454.CMB.1.raw
  modified_base (143)..(143): a, c, t, g, unknown or other
  misc_feature (143)..(143): n is a, c, g, or t
  modified_base (173)..(173): a, c, t, g, unknown or other
  misc_feature (173)..(173): n is a, c, g, or t
  modified_base (312)..(312): a, c, t, g, unknown or other
  misc_feature (312)..(312): n is a, c, g, or t
  modified_base (330)..(330): a, c, t, g, unknown or other
  misc_feature (330)..(330): n is a, c, g, or t
  modified_base (386)..(386): a, c, t, g, unknown or other
  misc_feature (386)..(386): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcgaggacacgngggtcctcggcccagtctcgccctgactcncgcctcgcctcgtgtcgtcggtctcgtgactagtcgactccgaccgttctcgtgacgacgtacggaacctagttaagtgttagttttaggtaactttcgaacttacgtcctacgtacgtaaccaactaacgtacccganaactaccgtaagttactntagttacgaggacgactaacgaggcccgtactagtaggttacctgtagcttccgtntcctaggcgtactcggaacggttcgaccggccgtaccccggtcttaaccgtgaaaacgttcgttacgtcggtaccgtaccgttacggacgggtctaagggtaacggaccgtaggttacctaacgttaacttaccggtagtcctagtacgtactagtacgttaggtacggttaattaccggtagtacgttacgggttgggtacccgggacggtacggacgtaacgtaccggtcgtaaccggttcaagggcctaccgaggtactcggtaccccgtcccgtacgtctacccttgacccctcgccttaccg

SEQ ID NO: 2922 - DNA, 679 bp, Homo sapiens
  misc_feature: GYAE6OF01D4VVG.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacgagggtcctgggcccagtctcgccctgactcagcctgcctccgtgtctgggtctctggacagtcgatcaccgtctcctgccacgtgggaccaagtattgtattttaggaaattttgacctagtctccgtacggtaaccaactaaccgtaccccggacaaacgtacccctaaagttaatacctattttagaggacggactacgtaacggccggaccctacgaggtacgtttcgtgtattcgactttcgtctacggcctacgagtcgtacgggccgtccggcctccgagactaagttcgtcgcgggtcctcgaggtcgtacggaacgggacgtacggtcttactacttacgttacgtcgtcgttcgacctagtaacgttggtaacgggtagttacgtacgtcgttacggtttgggtcggttcgggacgggtacgaaccgtaagtaccgtaccgtaccgtacgtaccgacggtaccgacggtcccgtcccgtccccggttaccgacctccgttaccgttccccttccccgtcccttacccgg

SEQ ID NO: 2923 - DNA, 683 bp, Homo sapiens
  misc_feature: GYAE6OF01CVGUG.12.21.B10.1.454.CMB.1.raw
  modified_base (215)..(215): a, c, t, g, unknown or other
  misc_feature (215)..(215): n is a, c, g, or t
tcagatacgacgtacacgaccggtgctcgatttagtgtcgtcgcaagagaggaggggggggtcacaagaggcagcgctctcgggacgcctccaccatggcctgggctctgctgctcctcactctcctcactcaggacacgacgggtcctcgggcccagtctcgccctgactcacgcctcgcctcgtgtctggtctcgtggacagtcgatccactntcctcctagcacgcggaaccagctaggtgacgttggttacgttaattaactttcgtcttccgtggtaacaacagccaccgacggaccaaacccgccccaactccgtagtattatgacgtactactagttccggtacctcgtaagtatttacgtaactccgttacttcttcgttacggttactaaacgttcgtacgtccaaacccgtacggtccctaccgtacgaaccttacgccggttcgtcgggtaccagggtctagggaacggacggtacgtacgttaacggtattacgtacgtacgtacgtagttacctaataacgtacgaacgttcctaacccgtttctaccgtttacgtacggttaggttccgggtcggtaccgggtaggtaaacctaggccttacggtaccgttacgtacgacaccgtacccggaagtcccttaccgtaccccgtcggtcctccggtttccc

SEQ ID NO: 2924 - DNA, 813 bp, Homo sapiens
  misc_feature: GYAE6OF01DV5X9.12.21.B10.1.454.CMB.1.raw
  modified_base (290)..(290): a, c, t, g, unknown or other
  misc_feature (290)..(290): n is a, c, g, or t
tcagatacgacgtacacgaccggtgctcgatttagtgtcgtcgcaagagaggaggggggggggtcacaagaggcagcgctctcgggacgcctccaccatggcctgggctctgctgctcctcactctcctcactcaggacacgagggtcctgggcccagtctcgccctgactcacgcctgcctccgtgtcgtgggtcctccgtggacagtcgatcaccgtctcctgcacgtggacctagtaatgtattttaggaatttcgactgtctctagtaaccaacaacgtacccganaacgtacctaagttaatctatttagtggacggacacgtaacggccggtaccctacggaggttacgttttcaggtacttccgtctttccgtcgttaccgggaccttaccggaacgggtccgttaccggggacccggtaccccggggtcccttacccgtaagggtaaaccttaaactttaccggtaccggttaccggggtacccttaacccgggtagggtacccggttaaggggaacgggtaaccggtacggggttacccttaccgttaacgtttacccgtaaccgttcgtaccgttacgtaccgttagttaaggttaacgttaggggttaacgtttaggtaacgtccggttacgggtttggggttacgggttccggggtaccggtaaccgggtaaccgaacgggttcccggtaacccggttaccgtaacggtacccgaccggtacccgtaacgggtccccgtaccccgtccccggtccgttacctacccggtttaccctttcccgtcccccgttcccgttaccg

SEQ ID NO: 2925 - DNA, 769 bp, Homo sapiens
  misc_feature: GYAE6OF01DDP0E.12.21.B10.1.454.CMB.1.raw
  modified_base (529)..(529): a, c, t, g, unknown or other
  misc_feature (529)..(529): n is a, c, g, or t
tcagatacgacgtacacgaccggtgctcgatttagtgtcgtcgcaagagaggaggggggggggtcacaagaggcagcgctctcgggacgcctccaccatggcctgggctctgctgctcctcactctcctcactcaggacacagggtcctgggcccagtctcgccctgactcagcctgcctccgtgtctgggtcctccgtaggacagtcgatccaccgtctctgcacgtggacagtatgtatttaggtaacttttgactagtcctccttacggaccaactaaaccgtacccgtacgtaaccgtaccctaacgttaatactatttacgtaggtacggacgactaacggtaccggccctacgtacggttacgtttcgtacgtacgttcgtacgttcgttactcggtaccgtaccgaacgggtcgtacggggtcccggaacccggtcccggtcccttagtaacgtacgtactcgtacgggcttccgacggcgtggacggtacgcgtactctaacttacttcgactccggttcncctagtacgttaaggttagggttacgtaacgttacggtacggttaccgttggggtttacgggccggggtaacgggtacccgggtaacgtaaaccggtccggtaaaccggttaccgtttaaccggaacccgaaccggttaacccgggaaccggttcccggttccccgccccccggggtttaacctacccgttaacccgttccccgttaaccccgtttcccccggttaccccttaaccccgg

SEQ ID NO: 2926 - DNA, 774 bp, Homo sapiens
  misc_feature: GYAE6OF01BOFG9.12.21.B10.1.454.CMB.1.raw
  modified_base (735)..(735): a, c, t, g, unknown or other
  misc_feature (735)..(735): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacacgggtcctgggcccagtctcgccctgactcagcctgcctcgtgtcgtggtctcgtggactagtcgactccactatcctcctgcacgtcggaaccagcaggtcgtacgttggtagttaataacttagtcgttcctccgtacggtaaccaacgtacgccaacccgagggacaacggtacccaccccctaaagtctaacgtcgtaacgttttagacgggtacgggactaaccggtaacggtccccggtaccccttagggtacggggtttttacccttacgtccgttctttccgtcggttacggtcccgttccggaactttcggtacccggaccaaccggcccgttccccgtacacggtaacctacgttcttacggccggtcctaagtcggcgaacggggacggacggtacgggtaccgtttagttacgtttacggtggttctaccgtagttaacgttacgggtaccgggttacggggttaaacgtcggtaacccgtttcggtttaacggacgttaccggttacctacgggggtttccggacggggtaacccggaccgttaaggcccggttaccggcccgttaggtccgggttaaccnccggaaccccggttacgtcccggttaccccgtaccccgg

SEQ ID NO: 2927 - DNA, 637 bp, Homo sapiens
  misc_feature: GYAE6OF01CRN8N.12.21.B10.1.454.CMB.1.raw
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
tcagatacgacgtacacgaccggtgctcgatttagtgtcgtcgcaagagaggaggggggggtcacaagaggcagcgctctcgggacgcctccaccatggcctgggctctgctgctcctcactctcctcactcaggacacagggtcctgggcccagtctgccctgactcagcctgcctcgtgtctgggtctcctggacagtcgatcgaccgtctcctgcacgtggacctagtatgtattttggaaatttgacctagtctcctgtaccaanaatacccgganaaacgtcccaagttacnctattangaggacacgtagcgcctgaggtntttcngactcgtacttctctaggctcgtaagtcgtcgctacctctaccncccgttctcggtaccaagttccgnggtacgggtccctccgtaggttcctagggaacggtattcggacggtacgttaagtactttacgtttaaccgnggtttnaacctgttaacgtcgtacgggtacttaccggaaccctaccgtaggtccggtacgggtcgggttacgttggttaccggaccggggacgtaaccacggtcccgtaggacccgttcggacggtcctacggacccctagggcccaccggccccgtggtacccg

SEQ ID NO: 2928 - DNA, 794 bp, Homo sapiens
  misc_feature: GYAE6OF01DMHMN.12.21.B10.1.454.CMB.1.raw
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
  modified_base (293)..(293): a, c, t, g, unknown or other
  misc_feature (293)..(293): n is a, c, g, or t
tcagatacgacgtacacgaccggtgctcgatttagtgtcgtcgcaagagaggaggggggggtcacaagaggcagcgctcgtcgggacgcctccaccatggcctggctctgctgctcctcactctcctcactcgagggcacgtacgggtcctcggaccaatctcgccctgactcacgtcctgcctcgtgtcgtcgggtctccgtggaccagtcgtactccacctntttccgngaccaccgaactaagtcgtgtacgttgtacgttattaacttcgtctcctaggtaacaacganaccaaccgacgacaaacccgcccctaactccgtagttacgtttagtcgtacgttaccaacgttacgttccgtacctacgtaagttaactttcgaacgttcgtcttaccggttcttaccggttacgtaacgtccgtacgaacccgtaacggtaccgtcccttaccgacgtacctacgtccttacgggtccgggtaccgtagccggtacggaacggtaccgggtatcgttaagttacgttactaccgtagaccgttaagtactaacggttacaacccggtaactttacctaccttacccggttcgttaacgggtttcccgttaagggggtttcggtccggggaaccgggttggaccggtaaacgtttccggttaaccggacccgtttaaagaccggttacccggaccggttaaaccccggttacggccccgttacccccggggaccctttaacccgggttcctaacccgttttcccggtcccccgttcccccgtttaaacccg

SEQ ID NO: 2929 - DNA, 773 bp, Homo sapiens
  misc_feature: GYAE6OF01CBZPB.12.21.B10.1.454.CMB.1.raw
tcagatacgacgtacacgaccggtgctcgatttagtgtcgtcgcaagagaggagggggggggtcacaagaggcagcgctctcgggacgccctccaccatggcctgggctctgctgctcctcactctcctcacgtcaggaccacgagggtcctcgggcccagtctgccctgactcagcctgcctcggtgtcgtgggtctcctggacagtcgatcaccgtctcctagccacgttgggaccaaggtaatgtaattttggaaaacttttgaaccttagtccttccgtaggtaaccaaacaacctaaccccggacaaaacgtaccctaaagttaactacctaatttagacggaacggtacctaacgttaaggcccggtaccctaggtaacgggtacgttttaccgtagtaacgttcgtactttccttcgtacggtccgtaccggtaagttcgtacggaccgaaaccgtaccggtcccttacccgtagaaacctaacttcccgtcgtacgggtcctaccgaacgggtctacgggaacggtacggaggtaacggtaatttaacgttacgtgttgtaccttagtagtacgtgggtacgggttaagttacgtacttacgtttaacgactttaccggtaccttacggttccgggacgggtaacggggaacctaaacgggtccgttaaccgggtaccggttccggtagggtaccctaaccgggacccgtaagggtccctacccggtacccccgttaggtaccctaacgtttcccggttaccccg

SEQ ID NO: 2930 - DNA, 768 bp, Homo sapiens
  misc_feature: GYAE6OF01ALAQO.12.21.B10.1.454.CMB.1.raw
  modified_base (249)..(249): a, c, t, g, unknown or other
  misc_feature (249)..(249): n is a, c, g, or t
tcagatacgacgtacacgaccggtgctcgatttagtgtcgtcgcaagagaggagggggggggtcacaagaggcagcgctctcgggacgccctccaccatggcctgggctctgctgcctcctcactctcctcactcaggacacgagggtccctgggcccagtctcgccctgactcacgcctgcctcgtgtcgtgggtcctccgtggacagtcgatccaccacttcctccgtcgtccacggtcgggacccngcgagtagagttcggttaggtaacctttacgttaacctcggttcctaccgttacggtaaccctaaccaaccacccgaaggaccaaaccccgaacccccaactacgtactgttaactttacgtaggtacggaacctaacgtacggcccggtacccgttacgggttacggggttttcttacgtaccgttcgtttccttcggtaccggtcctacgtacgttcgtaccgtaccgaacccgtccccggtcccttcccgtacgtaacctacgtccgtcgtccgggtacccttacggtaccggtcgaggtaaccgggacgggtacggtacgttattaacgttccgttgttcgtctagtacgtggtacggcggttacgtgtaccttacgtttgtacgttcggtaccgtacgggtacgggtacgggaccgtaggtacccgtcgggtccctacgggttccggtcgggtaacccccgtcgggaacccgttaccggtacccggtccccgtacccgggtcccggtttacccg

SEQ ID NO: 2931 - DNA, 816 bp, Homo sapiens
  misc_feature: GYAE6OF01CYXP7.12.21.B10.1.454.CMB.1.raw
  modified_base (467)..(467): a, c, t, g, unknown or other
  misc_feature (467)..(467): n is a, c, g, or t
  modified_base (800)..(800): a, c, t, g, unknown or other
  misc_feature (800)..(800): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacgagggtcctgggcccagtctcgccctgactcagcctgcctccgtgtcgtggtctcgtgacagtcgactccaccgtctccgtgctacgtcgggacctaagtaagttgtattttaggtaaattttcgaccttagttcctaccgtacggtaacccaactaaccgtaccccggactaaaccggtacccctaaagtttaactctaatttacgaggtacgggactacgtaacggcccgtaccccgtagtaggttacgtttaccgtagtactccgtactttctcgttacggccttaccgacggtcgtacgggcccgtaccgggtccctccgtanacgtaactgtcggtcgtcctccgaggtctacggggaagtaacggcggtacccgttataacgttaccgtagtccgtaccgtcggtccctacgttaaggttcggtaacggtttggttaactacgggttacgtttaaccggggtttgggggttaccggggtttccccggggaacggggtaaccccggttaaccggtaaacgggttcccggttaaacccggtacccgttacggtaacccgggaaccgtaaccccgggtaccggtccccggtacccccgggttccccgtacccgggtccctttaccccggtttacccgtcccccggttttaccccccnccccggttttaccccg

SEQ ID NO: 2932 - DNA, 855 bp, Homo sapiens
  misc_feature: GYAE6OF01C645H.12.21.B10.1.454.CMB.1.raw
  modified_base (524)..(524): a, c, t, g, unknown or other
  misc_feature (524)..(524): n is a, c, g, or t
tcagatacgacgtacacgaccggtgctcgatttagtgtcgtcgcaagagaggaggggggggggtcacaagaggcagcgctctcggggacgcctccaccatggcctgggctctgctgctcctcactctcctcactcaggacacgagggtcctgggcccagtctcgccctgactcacgcctcgcctcgtgtcgtggtctccgtgacagtcgactcctaccgtctcctgcctacgtacggactagttaattgttaagttttaggtaaacttttcgaccttacgttcctaccgtacggtaaccaacgtaaccgtaccccggaactaaaccgtaccctaaagttactactaagtttagacggacggtactaacggtaaggccggtaccctaggtaggttactttcgtagtacgtccgtcctttccgtcgtaccggccgttaaccggacgggtccgtaccggggtacccggtaccccggtacccgttccgtaagaacttaaaccgtcggttccggtacgtcccgtacggnggttaccgacggggaacgggtaacgtccggtactttaaccgtaactttaacccgtcgtcgactttccggaaccttgtaacggtttaggtaacgggtttaggttactacgggttaaccgggtttgggttaccgggggtttcgggaacccggggtccggttaaacccgggaacggttaacggtcccgggttaacccgtacgttaaaccggccccggtaaaccggtcccccgggtaaacggttccccggtacccccggttaccccccgggttacggttccccttacccgtttaccccggtcccccttacccccccggtttccgttaacccccgg

SEQ ID NO: 2933 - DNA, 743 bp, Homo sapiens
  misc_feature: GYAE6OF01DF74U.12.21.B10.1.454.CMB.1.raw
  modified_base (346)..(346): a, c, t, g, unknown or other
  misc_feature (346)..(346): n is a, c, g, or t
  modified_base (391)..(391): a, c, t, g, unknown or other
  misc_feature (391)..(391): n is a, c, g, or t
tcagatacgacgtacacgaccggtgctcgatttagtgtcgtcgcaagagaggagggggggggtcacaagaggcagcgctctcgggacgcctccaccatggcctggctctgctgctcctcactctcctcactcaggacacgagggtcctgggcccagtctgccctagactcagcctgcctcgtgtacgtgggtctccgtgacagtccgatccgaccgtctccgtggacctacgtcgggacctagttaatgttaagttttaggaaacttttcgaccgttagtcctcgtacggtaaccaacgaaccgtaacccggactaaacgtaccccaaagttacacgtaatttagnggtacggtacaacgtaacggccgtaccgtacgtaggtcttttacncgtaacgtccgtacgttcgtacgtcggctaccgaacggtcgacggtcccggtaccggtcctacccgtagaacttacgtacgtcggtccggactaccgaagtcgtcggaaggtaccgtacggtcttaacgtaacgtttacgacgttcggcgttacgtacctagttaacgttagtaacgggttaagttacgtcgtaaccggtcggtttcggggtccggtacgggaccgggaaccgtacgtaacggttacccgtaccgtaacgtaacggtccgaacccgtccggaacgtcccgaacccggtccccgtacggttaccctaccgtttcccggtacccttcccccgtacccgttaacg

SEQ ID NO: 2934 - DNA, 782 bp, Homo sapiens
  misc_feature: GYAE6OF01BF38E.12.21.B10.1.454.CMB.1.raw
  modified_base (359)..(359): a, c, t, g, unknown or other
  misc_feature (359)..(359): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacgagggtcctgggcccagtctgtcctgactcagcctgcctcgtgtctgggtctcctggacagtcgatccaccgtctcctgccacgtgggaaccagtaatgtaattttcggaaattttgaacctagtctcctggtaccaacaactaccccggacaaaacgtcccaagttaactctaatttactgaacgggcaacgtaacgcggccctagaggtacgtttcnggacttccgactttctcgtcggtctaccgaaggcgtcgggaccggtaccccggggcccttcccgagtaaacctaaagttacgtacgttcggggaccttacccggaacggtcgttacggaacggggtaccggaacgggtacccttacgtaacggtttaacctacgttacgggtccttacgactttccgaagttaacggttagggtaagttttacgtaaaggtcccggttaacggtttgggggttacggtttaccgggggccgggaaccggggtaaccgtaaacgggttccgtaaacccggttacccgtaaacggttccggtaaacccgcccggtaaacgggttccccgtaccccggtaccccccgttcgggtaccccttacccgttaccgtttcccggttcccccccggtaccgtttccccccg

SEQ ID NO: 2935 - DNA, 681 bp, Homo sapiens
  misc_feature: GYAE6OF01BRUA8.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctaggacagtcgatccgaccgtctcctgcacgtgggaccagtatgtatttaggaatttgacctagtctctgtaccaacaactacccggacaaacgtcccaagttactactatttagtgaggctaacgtaacggccgaccctagtaaggtacgtttcgtagtatccgtctttaccgtcgtcggtacctaccgaaggtcctcggcccggtaacccggtcctcccgtagaacctaatacgtaccggtcgggtcctaccggtacggtcgtacgggaacggaccggtagtaccgttactacgttactacgtctcgtcgtactactagtagtaggtaacgttatacgtcgtacggttgggtacgttcgggacggtacgggaacgtaacggtcgtacccgttaccgtaacgttaccggaccgtaccgaacggtccctcccggtacccccgtacgtcccgttactacccgttccgttacccccggtcccttacccg

SEQ ID NO: 2936 - DNA, 840 bp, Homo sapiens
  misc_feature: GYAE6OF01A47GI.12.21.B10.1.454.CMB.1.raw
  modified_base (284)..(284): a, c, t, g, unknown or other
  misc_feature (284)..(284): n is a, c, g, or t
  modified_base (359)..(359): a, c, t, g, unknown or other
  misc_feature (359)..(359): n is a, c, g, or t
tcagatacgacgtacacgaccggtgctcgatttagtgtcgtcgcaagagaggagggggggggtcacaagaggcagcgctctcgggacgcctccaccatggcctggctctgctgctcctcactctcctcactcaggacacagggtcctgggcccagtctgccctgactcagcctgcctccgtgtctgggtctcctggacagtcgatccaccgtctcctgcacgtggaccagtaatgtattttggaattttgacctagtctccgtgtaccaacaactaccccgganaaacgtcccaaagttaactctaatttactaggaggacctaacgtaacgccggtccctacgtaggtacgttttcgngtacttccgtctttcgtcgtcggtccttaccgaaggtcgtacggcccggtacccgggtcccttacccgtaggtaaacctaaagtttaccgtaccggttcgggaccctttacccggaagggtaccggttacgggaacggggtaccggaacgggtacctttaaccgtaacgtttaacccgttaacggttcgtacccgtttaacggcctttaccgtaaggtttaagtttacggggtaacgtttaacggtaacgtaccggtttaacgggtttgggggttaccgggtttccgggggaacgggttaccccggggaaacctaaacgggtaccgggttaaccccgttaacggttaaaccggttacccggaacccggttaaccccggaacggggttccccgttacccccgggtaccccccggttaccgggttaacccctacccggtttaccttttcccccgggttaccccccttaccccgtttaccccgg

SEQ ID NO: 2937 - DNA, 1137 bp, Homo sapiens
  misc_feature: GYAE6OF01BJMRF.12.21.B10.1.454.CMB.1.raw
tcagatacgacgtacacgaccggtgctcgatttagtgtcgtcgcaagagaggaggggggggtcacaagaggcagcgctctcgggacgcctccaccatggcctgggctctgctgctcctcactctcctcactcaggacacgacgggtcctgggcccagtcctcgccctgactcgacgtcctcgccctcgtgtcgtcgggttcctccgtgggactaggtcgacgtccaccgtctcctcgccgtacggtcgggaacctaagttaagttgttaagtttttaaggttaactttttacgacctttacgtccttaccgttacggtaaacctaaaccaaccgttaacccccgggaactaaaaaccggttaccccttaaaaaggttttaactaccgttaaaagttttacggtacgggaaccggggtacctaaaaccggttaaaaccgggtcccccggggtaacccctttacgggtaaacgggggtttttaccgtttttaacccgttcggggtaaccttttaccccggggttacctttttaccccggttcccgtttccggggggacccccgttttaaaccccgggaaacgggggttcccgggttacccgggggtaaccccggggttaaccccccggggggttacccccctttaaccccgggtaaacccgggtaaaaccgttttaaaaccttacgggtttcccccggggttttaacgggaaccccgtaaccccggtacggggtacccggtacgggggtaaaccgggtacccgggtaaacgggttacccttaaacccggttaaagtttaacccgttaaccggttccgtaccggttacggtccgtttaaccgtaaaggtttaaccgggttaaggggtttaccgtttaaggtttacccggtacgggtttaaccgggtttcgggggggtttaccgggttttaccggggggaacccggggttaacccggggtaaccggttaaacgggttcccgggttaaacccggtttacgtaaaccgggttacccggtaacccggtaacccccgaacgggtttcccgttacccccgggttaccccggttacccggtttacccggttacccgtttaccccggtttaaccccggttcccccccgttcccgttttaaccccccgg

SEQ ID NO: 2938 - DNA, 689 bp, Homo sapiens
  misc_feature: GYAE6OF01CW3IH.12.21.B10.1.454.CMB.1.raw
  modified_base (507)..(507): a, c, t, g, unknown or other
  misc_feature (507)..(507): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcacgcctgcctcgtgtcgtgggtctccgtggacagtcgatccaccgtctcctcgcacgtgggaccagtaatgttagttttggaaattttcgaccttagtctccgtggtaacccaactaacctaccccggacaaaccgtcccctaaggttaactcctaattttagacggacgggtacaaccgtaacggcccggccctaggagggtcgtttctgattccgtcctttcgtctcggcctaccgaaggtcgtcggccggacccggtccctaccgtacactaaacgttcgtcggtcggcctcgaaggtcgtaggacgtagtcggaggtctaggttacttactcgngactacgctcgtaatcgtcgacgtacgggacacggtaccttagtttaggttttcgtaaccggttcgggaccgttaccggtacccgtcgggtacccgtacccgttaccgggacgttacccggaccggaccccgaaacccgtacccaaccccgtactcggtaacccctgttccccggttccccg

SEQ ID NO: 2939 - DNA, 633 bp, Homo sapiens
  misc_feature: GYAE6OF01CDYSX.12.21.B10.1.454.CMB.1.raw
  modified_base (229)..(229): a, c, t, g, unknown or other
  misc_feature (229)..(229): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
tcagatacgacgtacacgaccggtgctcgatttagtgtcgtcgcaagagaggaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctctgcactggacagtangtatttggaaattttgactagtctctgtacacaatacccggacaaagtcccaagttanctatttangaggcactaagccgcctacaggtagtttcagactcgtctttcctctggtcctaccgaaggctgggccgaacccgggccctcctgaactaacgttagtcgtcggggccttacccgaggtcctaggaggaccgtaagggcttactaagttaaccttatcgtctcgtcttacattaagtggaagtttacgaagtacgtacggtttaggggttcgttacgggcggaccgggtacaaaaggtcgtaccgtacccgtaagtccgtaacgacccaaggtcccttaccggccccccgtttgggtaccctaaccgttcgttcccgtttccccctaacccgtttcccc

SEQ ID NO: 2940 - DNA, 651 bp, Homo sapiens
  misc_feature: GYAE6OF01BHVLK.12.21.B10.1.454.CMB.1.raw
  modified_base (304)..(304): a, c, t, g, unknown or other
  misc_feature (304)..(304): n is a, c, g, or t
tcagatacgacgtacacgaccggtgctcgatttagtgtcgtcgcaagagaggaggggggggtcacaagaggcagcgctctcgggacgcctccaccatggcctggctctgctgctcctcactctcctcactcaggacacgagggtcctgggcccagtcctgccctgactcagcctgcctccgtgtctggtctcgtggacagtcgatccaccgtctctgacactggaccagtatgtatttagaaatttcgacctagtctccgtgtaccaacactacccgacaaactccctaaagtactctatttangtacggacacgtaacgcggaccctagtacggtacttcgtgactcgtcttctcgtgcctacgaagtcgtcggaccgacccggtccctaccgtacgaactaacgttacgtcggtcggtccgtaccgacggtacgtacggaacgggtaacggtacgtacgttacgttaatttaacgttcgtcgtacgtcgtacctagtattacgagtccgtaaggtcgtacgtaccgtaactttccgacgttacgttacggtaccgggacggaacgaaccgtagacccgtccggtaccgttaccgacggtccaccgtaccgaccgtccgtaccccgttcccgaccgtctacccgttcccg

SEQ ID NO: 2941 - DNA, 665 bp, Homo sapiens
  misc_feature: GYAE6OF01CBCOJ.12.21.B10.1.454.CMB.1.raw
  modified_base (140)..(140): a, c, t, g, unknown or other
  misc_feature (140)..(140): n is a, c, g, or t
  modified_base (211)..(211): a, c, t, g, unknown or other
  misc_feature (211)..(211): n is a, c, g, or t
  modified_base (394)..(394): a, c, t, g, unknown or other
  misc_feature (394)..(394): n is a, c, g, or t
  modified_base (534)..(534): a, c, t, g, unknown or other
  misc_feature (534)..(534): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
  modified_base (566)..(566): a, c, t, g, unknown or other
  misc_feature (566)..(566): n is a, c, g, or t
  modified_base (618)..(618): a, c, t, g, unknown or other
  misc_feature (618)..(618): n is a, c, g, or t
  modified_base (651)..(651): a, c, t, g, unknown or other
  misc_feature (651)..(651): n is a, c, g, or t
  modified_base (660)..(660): a, c, t, g, unknown or other
  misc_feature (660)..(660): n is a, c, g, or t
tcagatacgacgtacacgaccggtgctcgatttagtgtcgtcgcaagagaggaggggggggtcacaagaggcagcgctctcgggacgcctccaccatggcctggctctgctgctcctcactctcctcactcaggacacgnggtcctcggccctaggtcctcgccctgacctcgacgcctcgtccctccgttgtcgtcggtcctcgtggacngtcgactccgtaccgtctccgtgactacgtacggaactagtaatgttaattttaggtaatttcgacgttagtccttccgtacgtaccaaacaccgtacccgaactaaaccgtaccctaagttaactacgttattaacgtaggacggacctacgtaaccggccgaacctcgaaggttctttagngtacttcgttcttcgtacggtccgaccgtaccgtaggtcccggtggacccggtaccccggtcctaacgtacgaaccttaacgtcgttacggtccgtaccgtacggacggtcgacggagtacgtcggactcgtaaccgttnacgttcnctagntacgagttacgagttacgtntcgtagtcggttggtcgtcgcggaacgcgtaagtccgtacgtaccaggtccncggtacgcgtcgtcccgcctcgtactacgtccnccttcccgngtccc

SEQ ID NO: 2942 - DNA, 913 bp, Homo sapiens
  misc_feature: GYAE6OF01COQRK.12.21.B10.1.454.CMB.1.raw
tcagatacgacgtacacgaccggtgctcgatttagtgtcgtcgcaagagaggaggggggggggtcacaagaggcagcgctctcgggacgcctccaccatggcctgggctctgctgctcctcaccctctcactcagggcacgagggtcctgggcccaatctcgccctgactcagcctgcctcgtgtcgtcgggtctccgtggacagtcgatccgacccgttctcctacgcctacgtcgggaacctaaggttaatgttaagtttttaggtaaaattttcgacctttaggttccttccgtacggtaaaccaacgtaaccgttaccccggaactaaaccgttaccctaaagttaactactaattttaacgaggaacgggtactaaccgtaacggccgtcccgtacgaggtttacgtttactagtacgttcgtcctttcgtaccgtggtaccttaccggaaggtccgtacggggcccggtaaccccgggtcccgttacccggtaggtaaacctaacgttacggttccggtacggggtaccttcccgggaacgggtcggttaacgggaccgggtaccggtacgggtaccgttaacgttaacctttaaccgtacggtacgttacgtacggttcctaacgtaagttacgggttaagggttaacggtttaacgtacggtaccgggtttaggttttacgggggttaccgggtttaccggggccggggtaaacccggggtaaaccgtaaccgggtaaccgggttaaccccgtaccggttaaacggtaccggtacccggtaacccggtaaccgggttaccccggttccccggtaccccccgggttaaccggttaccccgtacccgttttaccccggttaccccggtttacccccccgtcccgttttaaccccgggttaaccccgg

SEQ ID NO: 2943 - DNA, 836 bp, Homo sapiens
  misc_feature: GYAE6OF01DYWX5.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctggctctgctgctcctcactctcctcactcaggacacgagggtcctgggcccagtctcgccctgactcagcctcgccttcgtgtcgtgggtcctccgtggacgagtccgatccgtacccgtctccgtagcctacggtcgggaacctaaggtacttgttaagttttaggaaattttcgaccttagtcctaccgtaggtaacccaaacaacgtacccccggactaaacgtacccctaagttaatactagtttactgggacggtactaacgtaaccggtcccggacccgtacgtaacgggttacgttttacgagttaacgttccgtccgtttccgtcgtcggtacctaccggaacggtcggtaccgggcccggtacccgggtcccctccgtacgactaacgtacttcgggtccggtacctcccggaggtaccgtagggaaccgggtacgacggtctaccttaagttacctcgtacgtccgtagtccttagagtttacggtagggttaagttacgtaacggtaccgtttacggggtttcggggtttcgggtcccgggaccggggtaacggtaaccggttaaaggtaccccgggtaacccgttaccggttaaaccgtcggtaaaccccgggtaacccgtacgggtacccccgttccccggtcccccggttaccgggttacccctttaacccggttcccggtttaaccccccgttcccccgttacccccgtttaacccgg

SEQ ID NO: 2944 - DNA, 690 bp, Homo sapiens
  misc_feature: GYAE6OF01ATWAQ.12.21.B10.1.454.CMB.1.raw
  modified_base (173)..(173): a, c, t, g, unknown or other
  misc_feature (173)..(173): n is a, c, g, or t
tcagatacgacgtacacgaccggtgctcgatttagtgtcgtcgcaagagaggaggggggggtcacaagaggcagcgctctcgggacgcctccaccatggcctggctctgctgctcctcactctcctcactacaggacacgtacgggtcctcgggcccagtctcgcctgactcncgcctcgcctcgtgtcgtcggtctcgtgactgtcacgtccaccgtctcgtcgctaggtacggactagtagtgttagtttagtaattcgtactagtctacggtacgaaccaacgaaccgtaccgaactaaccgtacctaagtactagtattacgagacggtcctaacgtaccggtcgaccgtaggcgttacgttcgacttacgttcctgttcgcgtcggacgtcgacggccggtacggacccgtccgtccgtacgctaaaccgtgtcgttccgggcgtaccgcgtaggacggtacgggacgacgtacgtctaacgttacttacgaccgttatcgtcgttaagtccgtaagttacggtacgtcgttaacgtcggtacttacgggttgggttaccggtacgggaccgggtacgtaaccgtacgtaacccgtactacccggtacgtaccggtaccgaccgtacggtacccctcccgtacccgtaccgtcctttccgaccctcccgttcccgcgttacccgg

SEQ ID NO: 2945 - DNA, 677 bp, Homo sapiens
  misc_feature: GYAE6OF01CSW5R.12.21.B10.1.454.CMB.1.raw
  modified_base (242)..(242): a, c, t, g, unknown or other
  misc_feature (242)..(242): n is a, c, g, or t
  modified_base (281)..(281): a, c, t, g, unknown or other
  misc_feature (281)..(281): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
tcagatacgacgtacacgaccggtgctcgatttagtgtcgtcgcaagagaggaggggggggtcacaagaggcagcgctcgtcgggacgccctccaccagtcggccgtgggctctgctgctcctcactctcctcactcgaggacacgacgggtcctcgggcccagtctcgaccctgacctacgacgccctcgtcctcggtgtccgtcggggtcctccggtggactagtcgactccgtacctcncctcgacacggtggactagtatgtattaggtattcgctntacctacgtagtaaccaagtaaccgtccgactaaaccggtcctaaattctagtagttagaggagtacccagtacgccgacctaggtacgtnttgtacgacttccgtcttcggtntaacggttcccaggtcgtacggtcgggtcccggaaccggttccgccttaaaggacctagttacccgaggtcccggtctaagggcctaggacggacggacggtacgtacgttacgtattacgcgtacgtacgtcctaacgtgtaggttacgtaggtaacgttgtaacgcgttagggtcgttagggtcccgacgggtacggtaccgtaagtccgttacgacctagacgtaacgccgaccgtccggtccgcgttccgtacttcgtccgttccctccgtcctaccg

SEQ ID NO: 2946 - DNA, 814 bp, Homo sapiens
  misc_feature: GYAE6OF01D3OH2.12.21.B10.1.454.CMB.1.raw
  modified_base (209)..(209): a, c, t, g, unknown or other
  misc_feature (209)..(209): n is a, c, g, or t
  modified_base (322)..(322): a, c, t, g, unknown or other
  misc_feature (322)..(322): n is a, c, g, or t
  modified_base (493)..(493): a, c, t, g, unknown or other
  misc_feature (493)..(493): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacgacgggtcctgggcccctagtcgtcggcccctgaactcacgcctcgccttccggtgtcgtggtcctcgnggacacgtcgactccgacctctccgtgcacgtgggaccagtaatgttattaggtaatttcgactagtctcgtagtaccaacgaacctaccgacaaacgtaccctaagttaacncgtatttacgaggtaggacctaaacgttaacggccggtaccccgtagtacggtagttttacgacgtacgttcgtccttacgttccgttcggccctacgaaccgggtgtcggacccgggtacccggtcctaccgtacgtaaaccgttaacttccgtacggttcccggggtancccgtaccggtacggtaccggtacgggacggtacggtacgtaccgtacgttacgttaacgtacgtcgtacgtacgtacgttacgtacgttacgtacgggttaacggttacgtacggttaccggttacgggttaccggggttaccgggttaccgggtaaccggggtaaccgggtaaccgggtaacggtaaccggttaacccgtaccggttaccggtaccgtacccggtacccggtaacccggtacccggttacccggttaccccggttacccggttacccgttaccccgtttccccggttaccccgttccccgttacccccg

SEQ ID NO: 2947 - DNA, 822 bp, Homo sapiens
  misc_feature: GYAE6OF01B17M6.12.21.B10.1.454.CMB.1.raw
tcagatacgacgtacacgaccggtgctcgatttagtgtcgtcgcaagagaggaggggggggtcacaagaggcagcgctctcgggacgcctccaccatggcctggctctgctgctcctcactctcctcactcaggacacgacgggtccgtcgggcccagtctcgcccctgacctcacgcctgccctcgtcgtcgtggtctcgtagacgagtcgatcctaccgtctcctacgcgtacgtacggacctaagtaagttgttagttttaggtaaacttttgaccgttacgtcctcgtacgtaaaccaactaaccgtacccgactaaactcccgtaaagttacacttatagtacgacggtacacgacgtcccgtcctagacggttacttcgtcgtacgttccggcctttacggccgttcggtacccgtaccggaacgggttccgttacccggggaacccggtcccggtccctttacccggaataaaccggtttaccgtacgttcgtaaccgggtccttaccggaggtaccggttacgggaacgggtacggtaccggttacgtaccgtaaacgtttacccgtaacgtcgttacgtaccgtacgttaccgtaagtttacggtaagggttaccggttaagtaaccggttaccggttaccggtttaggggttccgggtaccgggtaccgggtaacggtaaccgtaaacgggtcctaaaccgggtacgttaccggtaaccgacccggtaccgaaaccggttccccgtacccggtacccgttcccggtacgtaccccttacccggttcccccgttacccgttacccccttccgg

SEQ ID NO: 2948 - DNA, 777 bp, Homo sapiens
  misc_feature: GYAE6OF01BJS6F.12.21.B10.1.454.CMB.1.raw
  modified_base (571)..(571): a, c, t, g, unknown or other
  misc_feature (571)..(571): n is a, c, g, or t
tcagatacgacgtacacgaccggtgctcgatttagtgtcgtcgcaagagaggagggggggggtcacaagaggcagcgctctcgggacgcctccaccgatcggcctgggctctgctgctcctcactctcctcactcgacggacacgacgggtcctcgggccctagtcctcgccctggacctcacgcctgcctccgtgtcgtcggtctccgtggtacagtcgactccaccgtctcctgcacgtcggaccagttactgttatttaggtaaattttcgaccttagtcctcgtacggtaccaaacgtaacgtaccccggaataaaccgtaccctaaagttactctaagtttcgacggaacggtacctaacgttaacggcccggtccttacggacgggttaccttttcgtacgtaaccttccgttcgtttcctacggttccggaccgttacgaaaggtccggtaccggcccgggtaccggtccttaccgagtaaactaaacgtttcttccgggacggtccttaccgggacgtaccggtaggacgggttaacgcgtaccttagtaacttacgacggtntcgtcgtactcgtattacggtaggttacgtacgtgtccgttaagggttcgggttacggtacgggacgggttacgtaaaccggtaggttccgaaacccggtttccgtaaaggtcccgtaaccgggtacgggaccgtccgtaccccgggttccgttaccgtacgtacccctttcgggtaaacccccttcccgtacccgtttaacccgg

SEQ ID NO: 2949 - DNA, 779 bp, Homo sapiens
  misc_feature: GYAE6OF01BAPRD.12.21.B10.1.454.CMB.1.raw
  modified_base (314)..(314): a, c, t, g, unknown or other
  misc_feature (314)..(314): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccaggtctgccctgactcagcctgcctccgtgtctgggtctcctggacagtcgatcaccgtctcctgcacgtgggaccagtaatgtattttaggaaattttgaccttagtctcctggtaccaacaactacccggcaaacgtccccaagttaactctatttanggaggcacgtaacggccggcccttcgaggtacgttttctagacttcgtctttctcgtggcctccgaagggctcgggccgacccgggtccctccgtacggaacctaacgttacgttccgtcggggtcctacccggacggtccgttacgggaacgggaaccggtacgggtacccttaccgttaactttaaccgttaaccgtcggcctttacggccctacgtaagtttaacggttacggggttaacggtttaacgttacgggaccttacggggttttacgggggttaccggtttcccgggggaccgggtaaccggggtaaacccgtaaagggttcccggtaacccggttaccgtaaacgggtcccgaaccggtaccccgaaacggggtccccttacccgggtaccccccgttcggttaccccgtacctttaccccgttcccggttacccccctaccccgtttaccccg

SEQ ID NO: 2950 - DNA, 937 bp, Homo sapiens
  misc_feature: GYAE6OF01BLDBL.12.21.B10.1.454.CMB.1.raw
tcagatacgacgtacacgaccggtgctcgatttagtgtcgtcgcaagagaggaggggggggtcacaagaggcagcgctctcgggacgcctccaccatggcctggctctgctgctcctcactctcctcactcaggaccacgagggtcctcgggccctagttccgtcgccctagacctcgacgtccgtcggtcccttccggtcggttccgttcggggttcctaccgttacgggacctacgggtaccgtaaccgttcccgtacccggttccttaccttcggaccgtaccgttaccgggggaaccctaaaggtttaagttaggttaagtttttacggttaaattttccgaaccgttacggttccttaccgtacggtaaaccaactaaccgtacccggaactaaaccgtaccctaaagttacttacttaagtttagtaggacggtaccaacggtacggaccggcctacgtaggttcttcgtacgacgttcgtctttacgcgtccggtactaaccggacgggtccgaccggggaccgtaccccgggtcctacccggtacgtaaacgtacttaacggttcccggaccgggtacccgtaaccggtacgggtacgtacggggaacggtaccggtaacgttacccgtaacgtttaaccgttaacgttacccgtacggtccgttacggtccttaacgtaaggttacggttacggtaacgtttacgtacgggttaccgtttacggggtttacggggttccggtaaccgggggtccgggttaaccgggtaaaccggtccgggttaaaccgtacccggttaacgtaaaccgtacccggtaaccggtaaccccggtcgggtaacccccggttccccggttaccccggtaccgggtttaaccccttacccggtttacccccgtaccccgttacccccgttccccgttaacccg

SEQ ID NO: 2951 - DNA, 674 bp, Homo sapiens
  misc_feature: GYAE6OF01DKIGR.12.21.B10.1.454.CMB.1.raw
  modified_base (63)..(63): a, c, t, g, unknown or other
  misc_feature (63)..(63): n is a, c, g, or t
  modified_base (129)..(129): a, c, t, g, unknown or other
  misc_feature (129)..(129): n is a, c, g, or t
  modified_base (285)..(285): a, c, t, g, unknown or other
  misc_feature (285)..(285): n is a, c, g, or t
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (412)..(412): a, c, t, g, unknown or other
  misc_feature (412)..(412): n is a, c, g, or t
  modified_base (511)..(511): a, c, t, g, unknown or other
  misc_feature (511)..(511): n is a, c, g, or t
tcagatacgacgtacacgaccggtgctcgatttagtgtcgtcgcaagagaggaggggggggtnacaagaggcagcgctctcgggacgcctccaccatggacctgggctctgctgctcctcactctcctnactcaggacacgaggtcctgggcccagtctgccctgactcagcctgccctcgtgtcgttgggtctccgtaggacagtcgactccaccgtctccgtgcacgtggacctagtaagtgtaattttaggaaattttcgacctagtctccgtagaaccaanaacgtaacccgactaaacgtacccaagttaacnctagtttanaggtaacggcaacgtaacggccgtaccctagtacggtcgtttacgtagacttccgtctttcgtcgtacggcgtaacgaggtccgngggtacccggaccgggtaccctctagtaactaaatcgtacgtcgggacttcgaggtactaggaacggacgtagacttactaacttaactacgtcgcgtntaccgtacgtaagttagtagggttacgttaataagtcgtaacgggtttgggtcgggttcggacgggtacggtacgtaaagtccgtaaccgtcggtaataccggacgaccgtaagtcctcccggtccccgtagttcaccttccgtaccgttccccgtctacccg

SEQ ID NO: 2952 - DNA, 534 bp, Homo sapiens
  misc_feature: GYAE6OF02JKB73.12.21.B10.1.454.CMB.1.raw
  modified_base (304)..(304): a, c, t, g, unknown or other
  misc_feature (304)..(304): n is a, c, g, or t
  modified_base (529)..(529): a, c, t, g, unknown or other
  misc_feature (529)..(529): n is a, c, g, or t
tcagatacgacgtacacgaccggtgctcgatttagtgtcgtcgcaagcgagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttangaggcactaagcggccctcaggatttctgatcgtcttctctgctcaaggctggcgaccggcctcctgacatactctgggctcgaggctgaggacgaggctacattacacgtgctgctcattagtggtacgttatagtcacgtttggggtacgttcgggcggcgggaaccaaggtcgaccgtcctaagtcgacgccaggcctcgcccgtcggcactctccgtcccncctcc

SEQ ID NO: 2953 - DNA, 701 bp, Homo sapiens
  misc_feature: GYAE6OF02IHDBC.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacgagggtcctgggcccagtctcgccctgactcagcctgcctccgtgtcgtgggtctccgtggacagtcgactcaccgtctcctgcacgtggaccagtaatgtattttaggtaaattttgacctagtctccgtggtaccaacaactaccccggacaaacgtaccccaagttaatctatttatgaggctaacgtaacggcggtcctcgaggtacgtttctgatcgtcttctctggctaccgaaggtcgtggccggacccgggtcctccctcgaactacgtacgtcgtcgggcctccgagctaggaggacgaggctacacttactacgtgtctcgtctacgttaagtacgtagggtagggtttaatacggtaccgttacggtttgggggttcgggttccggggtaccggggtacccgggtaaaccgtaaacgggtacggtaacccggttacccgttaaacggttccggaaaccgtccccgtaagggtcccgttaccccggtcccccggttccggtaccttacccgttcccgtttaccccggttacccccgtcccctttaccccgg

SEQ ID NO: 2954 - DNA, 578 bp, Homo sapiens
  misc_feature: GYAE6OF02GLVVT.12.21.B10.1.454.CMB.1.raw
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
  modified_base (449)..(449): a, c, t, g, unknown or other
  misc_feature (449)..(449): n is a, c, g, or t
  modified_base (569)..(569): a, c, t, g, unknown or other
  misc_feature (569)..(569): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaactaccccggcaaacgtccccaagttaatctatttatgagggcaactaagcggccctcgaggtagtttctgatcggcttctctgctccgaaggctggcgaccggcctccgtgacatntcnggctcgngctgacgacgagtctctagttactctgctgctcgtatgtagggtagttanagtcgtacgttggggtcttcgggaccgggtcggaaaccgtaaggtcgacccgttacgtaagtccgaacgacccgtaggcccgttccgccccttcggtccaccgttccgttcgttcccccncttaccccg

SEQ ID NO: 2955 - DNA, 728 bp, Homo sapiens
  misc_feature: GYAE6OF02HVPPA.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacgagggtcctgggcccagtctgccctgactcagcctgcctccgtgtctgggtctccgtggacagtcgatccaccgtctcctgcacgtcgggaccagtaatgtattttaggtaaattttcgaccttagtcctctacggtaaccaacaacctaccccggactaaacgtacccctaaagttaactactatttagtaggaacgggtactaacgtaacggccggtaccctacgaggtagtttcgtgtacgttcgtcttctcgtggtacctaccgaaggtcgtacggaccaacgtaccggtccctaccgtagaaccgtaacttccgtacgtcgggtcctaccggaggtcgtacgggaacgggacggtacgggacggtttaagttaacgtttacgttaggttcgtaccttacgtaagttagtacggggtacgggtttaagtacgtaccttacgtttcgtagtttacgttaccgttaggttccgggacgggtaacggtaccgtaagtccgttacggacccggttccggtacgggtacctacgtacccggtaaggtcctcccggtcccccgttcgtacccttccgttccgttccccgg

SEQ ID NO: 2956 - DNA, 700 bp, Homo sapiens
  misc_feature: GYAE6OF02GR57Z.12.21.B10.1.454.CMB.1.raw
  modified_base (551)..(551): a, c, t, g, unknown or other
  misc_feature (551)..(551): n is a, c, g, or t
tcagatacgacgtacacgaccggtgctcgatttagtgtcgtcgcaagatagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcacgtgggaccagtaatgtattttaggaaattttgaccttagtctcctggtaaccaacaacgtaccccgacaaacgtccccaagttaactctaatttagagagggcctaacgtaacggaccggtccctacgtaagggtacttttacgtgacttcggtccttctcgtcggaccttaccgaagggtcctcgggaccggtaaccccgggcccttcccgtaggtaaaccaaacttacgttccgtcggggaccttacccgagggtacctagggaacgggaacgacgggtcctactaagttacctacgtgtaccgtgtccctagattacggtaggttaggttaacncgttactacggtttggggttacgttccgggacgggtaccggaacgtaagtaccggaacccgttactaaggtccgaacgtacccggtaagtcccgttaccgccccgttacggtccctaccgtccgttcccgttaccccaccctttacccg

SEQ ID NO: 2957 - DNA, 804 bp, Homo sapiens
  misc_feature: GYAE6OF02JDPB4.12.21.B10.1.454.CMB.1.raw
  modified_base (353)..(353): a, c, t, g, unknown or other
  misc_feature (353)..(353): n is a, c, g, or t
tcagatacgacgtacacgaccggtgctcgatttagtgtcgtcgcaagagaggaggggggggtcacaagaggcagcgctctcgggacgcctccaccatggcctgggctctgctgctcctcactctcctcactcacggacacagggtcctgggcccagtctgccctgactcacgtcctcgcctcgtgtacgtgggtcctccgtcggacctagtcgactccgacccgttctccgtagctaccgttagggaccaagttaactggttattttaggtaaatttcacctagtcctccgtaggtacccaacaacgtacccccggactaaacgtacccccaagttaactactacttttaagngggtaacgtacctaaccgttaacgggaacccggtccccgttacggaacgggttacgtttaccgttcggtaactcccggttacttttccgtaaccgttcggtccctaaccggtaaacggggtccgttcgggacccgggtacccgggtcccttacccgtacgtaactaaacgttaacctccggtacgggtaccctaccggtacgtcgttagggaacggtacggtacggttccttacgtaacttccgtacgttcgcttacgccttacgacgttaggtcggttaagtaccgttcggacgttaccggttggggttcggttacccggggaccggtaaccgggtaacgtaaaccgggttccgtaaccggtacgtaaccgtgtaacccgtacgaacggtccctacccgtacccggtcttacccgtacttaccccggtcccgttacctacccccgttccg

SEQ ID NO: 2958 - DNA, 745 bp, Homo sapiens
  misc_feature: GYAE6OF02IL38N.12.21.B10.1.454.CMB.1.raw
  modified_base (313)..(313): a, c, t, g, unknown or other
  misc_feature (313)..(313): n is a, c, g, or t
  modified_base (416)..(416): a, c, t, g, unknown or other
  misc_feature (416)..(416): n is a, c, g, or t
tcagatacgacgtacacgaccggtgctcgatttagtgtcgtcgcaagagaggagggggggtcacaagaggcagcgctctcgggacgcctccaccatggcctgggctctgctgctcctcactctcctcactcaggacacgagggtcctggcccagtctgccctgactcagcctgcctcgtgtcgtggtctccgtggacagtcgatcaccgttctcctgcacgtggacagtatgtattttggaattttgacctagtctccgtaggtaccaacaacgtaccccggataaacgtccctaaagttaactctattttanggtacggctacgtaagccggtccctgaggtacgtttccgagttccgtcttctgtccggtcttaccgaaggtcgtcgggcccggtacccgggtcccttacccgngaacctaattacgtcgtacggccttaccgacggtcgtacggaacgggaacgtacggtaccttactaaacgtttaccgtaccgtcgtccgttacgtccgtacctagttaccggttagggtaacgtttaacgtagtaccgttacggttttcggggtacggtttaccggggcgggtaccggaaacggtaaacggttacggtaacccgtttacgtaccggttaccgaccggacccggttaaccggtccgtaaccccggttcccccgttaccggttacccgaccgttttcccggttaccggtttaaccccccctcccgtttacccgttacccgg

SEQ ID NO: 2959 - DNA, 838 bp, Homo sapiens
  misc_feature: GYAE6OF02G6HT8.12.21.B10.1.454.CMB.1.raw
  modified_base (215)..(215): a, c, t, g, unknown or other
  misc_feature (215)..(215): n is a, c, g, or t
  modified_base (287)..(287): a, c, t, g, unknown or other
  misc_feature (287)..(287): n is a, c, g, or t
  modified_base (322)..(322): a, c, t, g, unknown or other
  misc_feature (322)..(322): n is a, c, g, or t
  modified_base (367)..(367): a, c, t, g, unknown or other
  misc_feature (367)..(367): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatccaccgtcncctgcacgtggaccagtatgtattttggaaatttgaccttagtctcctggtaaccaacaacgtaccccgganaaacgtacccctaagttaactcctaatttttacgnggagggtacctaacgtaacggccggtccctagaggtacgttttcngtactccgtcttctcgtggcctaccgaagggtctcgggccgtacccgggtcctccgtagactaattacgtcgtcgggacctacgacggcttagggaacgggaacgtacgggtcccttactaactttaccgaccgttcggtaccgttacggtcccttacgtaaagtttacgggtacggggtttaaacgtttacgtaacgggttacccggtttaacgggttttcggggggtttaccggggttttaccccgggggaacccggggtttaacccggggtaaacggttaaaaaccgggtttcccgggaaacccccgggttttacccgaaacggggtttaccgaacccgggtaacccccgggtaaagggttcccccgttacccccgggtacccccgggtttaacccggtccggtttaaacccccgttcccgggttttaccccggtttacccccccgtaacccggtttttaccccgggg

SEQ ID NO: 2960 - DNA, 656 bp, Homo sapiens
  misc_feature: GYAE6OF02GF6QC.12.21.B10.1.454.CMB.1.raw
  modified_base (294)..(294): a, c, t, g, unknown or other
  misc_feature (294)..(294): n is a, c, g, or t
  modified_base (320)..(320): a, c, t, g, unknown or other
  misc_feature (320)..(320): n is a, c, g, or t
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatccaccgtctccgtgccacgtgggacctagtaatgtattttaggaaattttcgaacctagtctcctaggtaccaacaactaccccgganaaacgtccccaagttaatctatttangacgggcaactaacgccggccctcgaagggtacgtttctagacgtcgtcttcctctggcctaccgaaggcgttacggcgtaacccgggcctacccgtagaacctaatactcgtcgggctccgacgctaggaggacgaggtctacacgttacctacgtgtactgtcctagacttagtaggtagttagtcgacttacggttgggtcggtcgggacggtacggaacgtaacgtacgtaccgttacgtacgtaccgaaccgaccgtaacggtcccgtacccgtcccccggttacggtaccctaccgttccgtacccggttcccccgtacccgttaccccg

SEQ ID NO: 2961 - DNA, 897 bp, Homo sapiens
  misc_feature: GYAE6OF02IHBAC.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctcgccctgactcagtcctgcctccgtgtcgtggtctcctggactaggtcgactccgacccgttctaccgtacgcctaacggttcgggaaccctagttaaacgttgtaattttacgggtaaattttcgaaccttagtccttacctcggtaaccaactaacgtaccccggacaaacgtcccctaagttaatctaatttactaggtacgggactaacgttaacggccggtaccctacgtacggtacggttttctacggtaacttccggtactttccgttcgtacgggtacctaccggtaaacggtccggttaccgggaccggtaaccccggggtccctacccggttcgtaaaccgtaacttaacgtccggttaccggggtaccgtaccgacggggttacccttaggggaaccgggtaacggtaccggccgtttaacggaacgtttaaccttaaccgggttagccggtttaccgtaccgttaccgtaaacggtttacgggttaagggtaacgggttttaacgtaaaccggttacccggttagggttttacggggggttccggtttacgggggacccggggttaacccgggggaaacctaaaggggttacccgtaacccgggtttacccgtaaacggttacccgacggtaaaccccgggtacgtaaccccgtcccggttaacccccggttcggtaaccgttaccgttccccgtttcccgggttacccccttacccgttaccccg

SEQ ID NO: 2962 - DNA, 768 bp, Homo sapiens
  misc_feature: GYAE6OF02HBY0O.12.21.B10.1.454.CMB.1.raw
  modified_base (321)..(321): a, c, t, g, unknown or other
  misc_feature (321)..(321): n is a, c, g, or t
tcagatacgacgtacacgaccggtgctcgatttagtgtcgtcgcaagagaggaggggggggggtcacaagaggcagcgctctcgggacgcctccaccatggcctgggctctgctgctcctcactctcctcactcaggacacagggtcctgggcccagtctcgccctgactcagcctgcctccgtgtctgggtctccgtggacagtcgatcaccgtctcctgcacgtggaccagtaatgtattttaggaaattttgactagtctcctggtaccaaacaactaccccggacaaacgtcccctaaagttaactcctatttaagnggacgggactaacgtaacggccggtaccctacgaggtacgtttcgtagattcgtcttctcgtcggcctacgaacggtcgtcgggccggtacccggtccctcccgtagaaccgtaataccgttcggtacgggtacctaccggacgggtccgtagggaacggggaaccggtacgggtccttaccgtaacgtttaaccctaacgttcggtcgttacgtaccgttacaagttaacggttggttaaagggtttaactacgggtaccttacgggttttaggggttcgggttccggggaccggggtacgggtaaacccggtaacggttaccggtaacccggttacgtaacggtccgaaaccgggtacccgaaaccgggttcccgttaccccggtccccggttaggtaacccctccggtttaccccgtccgtttaccccccgacccctttcccgg

SEQ ID NO: 2963 - DNA, 817 bp, Homo sapiens
  misc_feature: GYAE6OF02ILQS3.12.21.B10.1.454.CMB.1.raw
  modified_base (247)..(247): a, c, t, g, unknown or other
  misc_feature (247)..(247): n is a, c, g, or t
  modified_base (480)..(480): a, c, t, g, unknown or other
  misc_feature (480)..(480): n is a, c, g, or t
tcagatacgacgtacacgaccggtgctcgatttagtgtcgtcgcaagagaggaggggggggggtcacaagaggcagcgctctcgggacgccctccaccatggcctgggctctgctgctcctcactctcctcactcaggacacgtacggtcctcgggcccagtctcgccctgactcagcctgcctccgtgtcgtcgggtctccgtggacacgtcgactcgaccgtctccgtgccacgtggaccagtangttagtttagtaatttcgaactcgttcctaccgtaggtaaccaaactaaccgtaaccccggactaaaacccgtaccctaaagttaactacttaagtttacgagggtacggacctaaagaaccggtcccggtaccctaggtaaaggtttccgtttcaggtacttccggtcctttacgtcgtaccggacttaccggaacggtcgtaccgggaaccggcccggtcccttaccgtanaacctagtccggtaccggtcggacccttaccggaggtcgtacgggaacgggaaccggtcgtaacccttagtaacgtttacgtaacgttcgtaccgttggtaccttacggtagtttaaacgggttacgggtaaggtttaacgtaacggtacccggtttaagggtttcggggtaccggttaccgggggaccgggtaacccggtaaaggtaaccgggttaccgtacccggtccgtaaacggccggtaaccggaccggtaaccgggtcccgttaaccccggttcccgtacggtacccgttaacccttccgggtcccctttaaccccgcccgtttaaccccg

SEQ ID NO: 2964 - DNA, 723 bp, Homo sapiens
  misc_feature: GYAE6OF02JIAWY.12.21.B10.1.454.CMB.1.raw
  modified_base (178)..(178): a, c, t, g, unknown or other
  misc_feature (178)..(178): n is a, c, g, or t
  modified_base (204)..(204): a, c, t, g, unknown or other
  misc_feature (204)..(204): n is a, c, g, or t
  modified_base (479)..(479): a, c, t, g, unknown or other
  misc_feature (479)..(479): n is a, c, g, or t
tcagatacgacgtacacgaccggtgctcgatttagtgtcgtcgcaagagaggagggggggggtcgacaaggaggcagcgctctcgggacgcctccaccatggcctgggctctgctgctcctcaccctcctcactcagggcacgagggtccctgggcccaatctgccctgactcagccngcctccgtgtctggtctcctcggacngtccgatccgccgtctcctgcactcggggaaccagtaattgtattttaggaaattttgaccttagtcctcctcggtacaacaacctaccccggcaaacggttccccaagtttaactactatttactggaggggacctacgtaaacggcccggtacccgtcgtagggtacgttttctcggattccgtcttctccgtcggtactcccgaacggtccgtacgggccggtacccgggcctcccgttaggactaatcgtcggtccggtcgtcctacgggnttcggaacgggtacggagggtcccttacggttactttaaaccctcgttcgcgttcgacccgttcgtaacttaggttcggtaaccggttagtacgtaccgttaccgggttgggttcgggttaccggggcgggaacccgggtaccgtaaacggtaccgccgttaaccgtgaaccggtccggtaaccgagtaccgtcccggcccgtccggtacaccggttctcccgttacccggccttcccgttacg

SEQ ID NO: 2965 - DNA, 766 bp, Homo sapiens
  misc_feature: GYAE6OF02IWXFK.12.21.B10.1.454.CMB.1.raw
tcagatacgacgtacacgaccggtgctcgatttagtgtcgtcgcaagagaggaggggggggggtcacaagaggcagcgctctcgggacgcctccaccatggcctgggctctgctgctcctcactctcctcactcaggacacagggtcctgggcccagtctcgccctgactcagcctgcctcgtgtctggtctctggacagtcgatcaccgtctcctgccacgtcgggaccagtaatgtattttaggtaaatttcgacctagtctcctagtaccaacaactaccccgacaaacgtaccctaaagttaatctatttataggacggacaacgtaacgccggtaccctaggtaggtacgtttcgtagtacgtccgtctttctcgtcggtcctaccgtaacggtcgtacgggcccgtaccccgggtccctacccgtagtaacctaaactcgtacggtcgggtcctaccggtacggtcgtagggaacgggacggtacggtccttacgtaacttaaccgttacgtcgtaccgtcgtcttacgtacgttaggtggtaagtttaagtacggtcgttaacggtttggggttacggttccggggtaccggggtaccggtaaacccgtaacgggtacccgtaacccgggttaccttaacggttcccgaaaccggaccccggtaaacggtcccggttacccccgggttaccccgtccggttaacccccgttccggtttccccgttacccccggtttcccccgtcccccgtttaaccccg

SEQ ID NO: 2966 - DNA, 869 bp, Homo sapiens
  misc_feature: GYAE6OF02F4JYM.12.21.B10.1.454.CMB.1.raw
  modified_base (803)..(803): a, c, t, g, unknown or other
  misc_feature (803)..(803): n is a, c, g, or t
tcagatacgacgtacacgaccggtgctcgatttagtgtcgtcgcaagagaggaggggagtgaggagcagcgctctcgggacgcctccaccatggcctgggctctgctgctctcactctcctcacgtcaggacacgtacgggtcctcgggccctagtcctcgccctgacctcacgcctcgcctcgtcgtcgtgggtcctacgtggtaccagtccgactccgaccgtactccgtcctacgaccgtaccgtacgggaacctaggtccgtaaggttcggttaaccggttttcggtaacggttaacttaaccgttcgttccggttaccttaccggtaaccgtaaaccgaacccggtaccgaccccgtaacccggtacggtaacccgtaacccggtaaccccttaacccccgttaagttaccggtaacgtttaccggttaacgttaacggtacgggtaacccggtacctaaccggttacggccccggttaccgttcggttaaccgttctaccttcccggtaacttccgtaccgtaccggtaccgtacccggtacgtccgtaacccggacccgtaaccggtacccgtcccttaccggtaacgttaacccggtcgttaccggtaccggtccggacccggttcggacggtacgtacggtaacggtacggtacgttacgttaacttccgttacggtcttccgtccgttaagtacgtttaccgccggttaaggttaacccgtcgttaaccgggtttccggtaaccgttacggtaccggttacggttaaccggtcggggtacggtaacccggtanacccgggttacgtacccgtcccggtgtacccggcctaacccgtacggtacgtccccgtacccttcg

SEQ ID NO: 2967 - DNA, 752 bp, Homo sapiens
  misc_feature: GYAE6OF02JDJIA.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctcgtgtctgggtctcctggacagtcatcaccgtctcctgcacgtgggacccaagtaactgtacttttagggtaaaattttcgaccttagttctcctacggtaaccaaaccgtaacgtacccccggactaaacgtccccctaaagttaactactaattttagtacgagggacaacgtaacgccggtccctagtacgggtattacctgacgttcgtaccgttctcgtcggtcctaccgtaaggtccgtcggacccggtaccccggtcctcccgtaagtaacctaagtaccgtccgtagggaccttcggaacggtcgttacgggaacgggtaccgtacggtacttaccgtaactttacgtaccgtacgtcgtcgtacgtacgttaacgtagtagggtacggtttacgtagtaccgttaggttacggggttacggtccgggtccggggtaaacggtaacccgtaagggttccggtaacccgttaccgtaacggtaccgaccggtacccgaacggtcctaccggtcccccgtaggtacccgtaccgttccggttacccttacccccgtaccgttaccccg

SEQ ID NO: 2968 - DNA, 714 bp, Homo sapiens
  misc_feature: GYAE6OF02FZ78P.12.21.B10.1.454.CMB.1.raw
  modified_base (284)..(284): a, c, t, g, unknown or other
  misc_feature (284)..(284): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
tcagatacgacgtacacgaccggtgctcgatttagtgtcgtcgcaagagaggaggggggggtcacaagaggcagcgctctcgggacgcctccaccatggcctgggctctgctgctcctcactctcctcactcaggacacagggtcctgggcccagtctgccctgactcagcctgcctcgtgtcgtgggtctccgtggacagtcgatccaccgtctcctgcacgtgggaccagtaatgtattttaggaaatttgacctagtctcctgtacaacacgtaccccganaaacgtcccaattaatctattatggaggacacgtaagccggaccctcgaggtagtttcngactcgtcttctntcggctacgaggtctcggccgaccggtcctccgagaactaatacgtcggtacgggcctccgaggtccgtaggaacgggcggacggtactaccgtaagtttaacctacgtcgtccgttcgtccgttacttaacgtaggttcgggttaacggtttaagtacgtaccggttaaccgggttggggtttcgggttacccggggacggggaacccggttaaaccgaaacgggtacggttaccccggtacgtaaccggtacccgaacggtaaccccgtaacgggtcccgtcccgggttaccccccgtagggttcccctaaccggttcccgtttaccccgttacccccctacccgtttacccccgg

SEQ ID NO: 2969 - DNA, 792 bp, Homo sapiens
  misc_feature: GYAE6OF02HFJZX.12.21.B10.1.454.CMB.1.raw
  modified_base (402)..(402): a, c, t, g, unknown or other
  misc_feature (402)..(402): n is a, c, g, or t
tcagatacgacgtacacgaccggtgctcgatttagtgtcgtcgcaagagaggaggggggggggtcacaagaggcagcgctctcgggacgcctccaccatggcctgggctctgctgctcctcactctcctcactcaggaccacgagggtcctgggcccagttctcgccctgactcacgcctcgcctccgtgtcgtcgggtcctccgtaggacagtcgactccgaccgtcctccgtgctacggtcggaacctagttaatgttagttttaggtaatttcgaccttagtcctccgtaggtaaccaaactaacgtaccccggactaaaccgtacccctaaagttaactactaactttagacggacgggacctaacgtaacggcccggtcctacgtaggtcgtttacncgtactccgtactttcgtcggttcgaccgtaccgtaacggtcggtcgggacccggtcccggtcccttaccgtacgaactaatacgtcgtaccgggtcctaccggacggtcgtacgggtaacgggacggtacgtacctacgtaacgttaccgtacgtcgtacttcggtacctacttagtacggttaggttaaggttacgacgttacggtagggtttacgggtccgggttacgggacgggtaaccggtacgtaacgggtaccgttaccgtaccgttaacggtacccggtaaccggtacccggtaaccggttcccggtaccccgtaccccggttaccgtcccggttacccgttcccgttaccccggttacccccttaccccggtttaaccccg

SEQ ID NO: 2970 - DNA, 843 bp, Homo sapiens
  misc_feature: GYAE6OF02HSGP1.12.21.B10.1.454.CMB.1.raw
tcagatacgacgtacacgaccggtgctcgatttagtgtcgtcgcaagagaggaggggggggggtcacaagaggcagcgctctcgggacgcctccaccatggcctgggctctgctgctcctcactctcctcactcaggacacgacgggtcctgggcccagtctcgccctgactcagcctgcctccgtgtcgtgggtctcgtaggacacgtcgactccaccgtcctccgtcgacctacgtcgggaacctaagttaacgttagttaagttttaggttaaacttttcgaccgttaacgttccgttaccgttacggtaaacccaaaccgtaaccgtaacccccggaaccgtaaaccgtacccctaaagtttaactacttaagtttagtacggacggtaacctaacggtaacggcccggtaccctacggtaggttaactttcgtacgtacttcggtcctttcgtcgtaccgtacctaccggtacggtcgtccggggacccggtaccccgggtccccttaccggtaacgtaaaccgttaacgttaccgttaccgggtccggtcccgttaccggaccgggttaccggtaagggaaccgggtaacgtacggtacctacttaaccgttaccttacggtctaccgttcgtaccgtacgtaacgttaggttacggttaacgttagtaccggttacggtttcgggtttagggttcgggtaacccggggaccgggtaaccggaaaccggtaacggtaccggttaccgttaccgtaacgtaccggaaccgtaccggtaccgtcccgtaccccggtccgtacggtccctaccgttccgttaccccgtccctcctacccg

SEQ ID NO: 2971 - DNA, 890 bp, Homo sapiens
  misc_feature: GYAE6OF02IIS5H.12.21.B10.1.454.CMB.1.raw
  modified_base (261)..(261): a, c, t, g, unknown or other
  misc_feature (261)..(261): n is a, c, g, or t
tcagatacgacgtacacgaccggtgctcgatttagtgtcgtcgcaagagaggaggggggggggtcacaagaggcagcgctctcgggacgcctccaccatggcctgggctctgctgcctcctctactctcctcacctcgaggacacgtacgggtcctgggcccagtctcgcctgactacagcctcgacctccgtgtcgttcgggtctaccgtgtacacggtcgactccacccgttctctcgacgtaccggtcgggaccgacnccgtagtcggtagttggttacggtaaacttaacttaaccgttcgtcctaccgtacggtaaacccaaaccaacccgaacccgacggtaaacccaaaaccccgtaccccctaaaacttaccgaagttacgttaagtttacgggacgggaaccggtacctaacggtaccggccccgttacccgttacgggttacgggttttaccttacgccgtttcgttacgtccggttccggtacgttaccggtaggttacccgttacggaaccctaacccggtaccggttcccttaacccgtaggttaaccctaaccgtttcccgtaccggtcggtacccctaaccgggtacggtacggttaaccgggacggtaaacccgggtacggggtaactttaactttttacggttaccggtttacgttccggtaacctttaagggtactttacgggaacgggtttacggttaccgtaacggtttccctttaacgtttcggtaacttccggttacgtaacggtccgggtaccgggacggttaacccaggtttccggaaaccgttccggttaccggtaaccggttacggacccgttaacggaacccggttccccgacccgggtttcccgtacgtaccccgtttcccg

SEQ ID NO: 2972 - DNA, 711 bp, Homo sapiens
  misc_feature: GYAE6OF02JR2Q4.12.21.B10.1.454.CMB.1.raw
tcagatacgacgtacacgaccggtgctcgatttagtgtcgtcgcaagagaggagggggggggtcacaagaggcagcgctctcgggacgcctccaccatggcctgggctctgctgctcctcactcctcctcactcagacacagggtcctgggcccagtctcgccctgactcacgcctcgcctccgtgtcgtggtctcgtgacagtcatcctaccgtctccgtagccacggtgggaacctaggtaattgtagttttaggtaaattttcgacctcgtctaccgtacgtaaccgaacaactaccccgactaaacgtacccctaaagttaactactattacgtggtacggtctaacgtaacggccgtaccgtacgtacggtactttacgagtactcgttcttcgtcgtagcctcgaacgtcgtcgccgtaccggtcctaccgtagtaaactacgtactccggtcggtacctacgggacgtcgtaaggcggtacgagtcttaccgtacgtaactcgtcgtacgtgtacctacgtagtaacgttcgggtaagttacacggttgttaacgggttcggttagggcccggtaacgggtaccgtaaacgttaacggccgttaaccgttacgtacgtacgtaaccggcccagggtccccgtcccgtaccccggtaccgttacgacccgttacccggttccctacccccggttaccttacccgg

SEQ ID NO: 2973 - DNA, 783 bp, Homo sapiens
  misc_feature: GYAE6OF02FM6DH.12.21.B10.1.454.CMB.1.raw
  modified_base (564)..(564): a, c, t, g, unknown or other
  misc_feature (564)..(564): n is a, c, g, or t
tcagatacgacgtacacgaccggtgctcgatttagtgtcgtcgcaagagaggaggggggggggtcacaagaggcagcgctctcgggacgcctccaccatggcctgggctctgctgctcctcactctcctcactcaggacacagggtcctgggcccagtctcgccctgactcacgcctgccctccgtgtcgtgggtcctccgtaggacagtcgatccaccgttctccgtgccacgtgggacctaagtaatgttagttttaggaaattttgaccttagtccgttccgtacggtaaccaacgtaaccgtaccccggataaaccgtacccctaaattaactcttaagtttagaggacgggaccaacgttaacggcccgtacccgtacgtaaggttacgtttcgtacgtacgttccgttaccttcgtcggtcggtaccttaacccggtacggtcggtccgggacccgggtccccgggttccctacccgtacgtaacgtaaacttcggttcgtccgggtacctccggaggtaccgtaggaccgggtacgcggtctacctaacgtttaccncgtgtccgtgtacccttagacgttaggtaggtacgttagtacgtcgttaggtttcggggttcggtaccggggtaccgggtacggttaaaaccgtacgggtaccgttaacccggttacgtaacggtaccggaacgtacccggtaaccggtcccgttccccggtcccggttaccgccgtttaacccgtcccgtttaccccggttccccgtccccttccggg

SEQ ID NO: 2974 - DNA, 767 bp, Homo sapiens
  misc_feature: GYAE6OF02FGLPN.12.21.B10.1.454.CMB.1.raw
  modified_base (423)..(423): a, c, t, g, unknown or other
  misc_feature (423)..(423): n is a, c, g, or t
  modified_base (502)..(502): a, c, t, g, unknown or other
  misc_feature (502)..(502): n is a, c, g, or t
tcagatacgacgtacacgaccggtgctcgatttagtgtcgtcgcaagagaggagggggggggtcacaagaggcagcgctctcgggacgcctccaccatggcctgggctctgctgacctctcactctcctcactcgaggacacgaggtcctcgggccctagtctcgccctgactcacgccttcgcccgttcgtgtacgtcgggccttccgtggaccaggtcactacgaccgtcgtcctgaccacgtacgggaacctagtaagtcgttaagttttggtaacgttttcgaaccttcggtccacgttacggtaacaaaacctaccggtaccccgaactaaccggtaccctaaaaggttaactaccttaattcggtaaggaaccgtacctaaggtaaccgtcccggtacctaggttaaggttccgttnacgttgtaccgtccgtttactccgaggtcctaacggggtacctcgggtaccggaaccggtcccggttaccctcggtaanaacttacgtcgtccggtaccacgtacgtaccgggtacacggtaccggacttaccggtcgttaacgtaccgtttaccgaggtccgtaacgtctaccgattaacgtacggttagaaccgttaccgtaacggtcgttcggttaacgggttccgacgggtaccggtaagtaccgagttaacccgagttacaccggttcgaaccgacggtaccgacccgtaccgtaccgtcgaccccgttattcccggtaccctttcccgacctacccgg

SEQ ID NO: 2975 - DNA, 530 bp, Homo sapiens
  misc_feature: GYAE6OF01DRY0B.3.18.B07.1.454.CMB.1.raw
  modified_base (475)..(475): a, c, t, g, unknown or other
  misc_feature (475)..(475): n is a, c, g, or t
tcagagacgcactccacgaccggtgctcgatttagtcgctgcgtaaaggaggaaagggggggtctcaggaggcagcgctctcgggacgtctccaccatggcctgggctctgctattcctcaccctcctcactcagggcacagggtcctgggtcccagtctgccctgactcagcctgcctccgtgtctgggtctcctggacagtcgatcatcgccagtctcctgcactggaaccagcagtgacgttggtgttataactatgtctctggtatcaacagcaccaggcaaagcccccgaaaatcataatttatgatagtacagtaatcggccctgagggtttacaatcgcttctctggttacaagtctggacacacggcctccctgacctatctctagggcttccaggctgaaggacgaggctagaattattactgcagctcatataacaagcagcagcacgtggggtctacgggaacnggggaacctaaggtcaccgttcgcccacgtcacgcccaacggcccaacccgtacg

SEQ ID NO: 2976 - DNA, 580 bp, Homo sapiens
  misc_feature: GYAE6OF01EUGVH.3.18.B07.1.454.CMB.1.raw
  modified_base (233)..(233): a, c, t, g, unknown or other
  misc_feature (233)..(233): n is a, c, g, or t
  modified_base (447)..(447): a, c, t, g, unknown or other
  misc_feature (447)..(447): n is a, c, g, or t
tcagagacgcactccacgaccggtgctcgatttagtcgctgcgtaaaggaggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttggtgttataactatgtctctgtatcaacagcaccaggacaaacgcccccaaactcataattatgatgtcagtaatcgccctcgtagggtttctaatcgtcttctctgttacaagtctggacaacgccgtcctccctgacctactctccgtacgggctccgaggtctaggaggacgaggcgtagtattacttacgtgctacgtntacatactacaagtacgcacgactacggttggggtacttacgggtacgtacgggtaaccgtacggtccctacccggtccgtacccgaccgttaccgaacggacccgaaaccggccccaaaccccgcgttaccg

SEQ ID NO: 2977 - DNA, 545 bp, Homo sapiens
  misc_feature: GYAE6OF01C7VHX.3.18.B07.1.454.CMB.1.raw
  modified_base (356)..(356): a, c, t, g, unknown or other
  misc_feature (356)..(356): n is a, c, g, or t
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
tcagagacgcactccacgaccggtgctcgatttagtcgctgcgtaaaggaggaaaggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcatcgccatctcctgcactggaaccagcagtgacgttggtgttataatatgtctcctggtatcaacagcaccaggcaaagccccaaactcataattatagatgtcagtaatcggccctacagggttctaatcgcttctctgttacaagtntggactacacggcctcctgaccatctcgtggctcgagctgaggacgngctgtattatactgcagtctanaatataacgaagtcagcagcgtacgtacggggttactcgggtaacgtcggggaacctaacggtccaaccggtaccgtaccccgtacgtccgaacgacccgaaacggccctaaccctaccg

SEQ ID NO: 2978 - DNA, 671 bp, Homo sapiens
  misc_feature: GYAE6OF01CSDUI.3.18.B07.1.454.CMB.1.raw
  modified_base (274)..(274): a, c, t, g, unknown or other
  misc_feature (274)..(274): n is a, c, g, or t
  modified_base (315)..(315): a, c, t, g, unknown or other
  misc_feature (315)..(315): n is a, c, g, or t
  modified_base (466)..(466): a, c, t, g, unknown or other
  misc_feature (466)..(466): n is a, c, g, or t
  modified_base (494)..(494): a, c, t, g, unknown or other
  misc_feature (494)..(494): n is a, c, g, or t
tcagagacgcactccacgaccggtgctcgatttagtcgctgcgtaaaggaggaaaggggggggtctcaggaggcagtgctctcgggacgtctccaccatggcctgggctctgctattcctcaccctcctcactcagggcacagggtcctgggcccagtctgccctgactcagcctgcctcgtgtctgggtctcctggacagtcgatcatcgccatcctcctgcactggaaccagcagtgacgttggtagttataactatgtctctgtatcaacngccaccaggaccaaaacgaccccctaaactcattaatttangtatggtacaagtaactccggcctggtacgggtttactaactcgtctttactcgttacggttaacaacgttcgtacggtactaaacccgaaccggtcccctacctacgacctacttccgtacgtcgggtcctccgaggtctaggaggacgnggtctagtattactactgctagtcctanaattaactaaccgaaagcgtaacgcgaacgtcccgtaacggtttaccgggttacgtacggtaaccggtacggggtaaaaccctaacggggttacccctacccgggttaccccgtaaccccgtacggtacccgaaccggaacccccggtaaaccgaccccccgtaaaccccgtacccg

SEQ ID NO: 2979 - DNA, 626 bp, Homo sapiens
  misc_feature: GYAE6OF01CJ562.3.18.B07.1.454.CMB.1.raw
  modified_base (232)..(232): a, c, t, g, unknown or other
  misc_feature (232)..(232): n is a, c, g, or t
tcagagacgcactccacgaccggtgctcgatttagtcgctgcgtaaaggaggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatctcctgcactggaaccngcagtgacgttgtgtatactatgtctctgtatcaacagcaccaggaccaaacgacccccaaactcaacttaatttatagtatgtacaagtaactccggtccctcgtaggggtttactaactcgtcttctcgtaggttaacagtctggtacaaccgacggtcctccctcgaacctatccgttacgtcgggacctccgaggcgtggacggacggaggtctagtatttacgtactgcagtctacaattataccaagctagacgaagaccgtacggttcggggtccgttaacgggaacgtacggggaacccgtaacgggttacccgtaacccggttcccggtacccgaacccgttacaaccgggtaaccccgaaaccggcccccgaaacccctcccgg

SEQ ID NO: 2980 - DNA, 765 bp, Homo sapiens
  misc_feature: GYAE6OF01C7EQ7.3.18.B07.1.454.CMB.1.raw
  modified_base (236)..(236): a, c, t, g, unknown or other
  misc_feature (236)..(236): n is a, c, g, or t
  modified_base (263)..(263): a, c, t, g, unknown or other
  misc_feature (263)..(263): n is a, c, g, or t
  modified_base (325)..(325): a, c, t, g, unknown or other
  misc_feature (325)..(325): n is a, c, g, or t
tcagagacgcactccacgaccggtgctcgatttagtcgctgcgtaaaggaggaaagggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcatcgtcatctcctgcactggaaccngcaggtgacgttggtagttaataactntcgttctccgtaggtatacaacagccaaccgaggaccaaacgcccccaaatcaattaattangatagacaagtactcgacctagtagggttactacgtcgtcttcgtacgtacggttacaaggttccgtaggtaaccaaccgtaccggtaccccttaccgtacgaacccttacgtccgttcggtcgggtaccttaccggagggtaccgttacgggaacgggaaccggtacgggtcttaacgttaacgttttaacctacgtcgtaaccgtacgtaccgtaactaaataaccttaacggaacgtacgaacggtaccaacgggtaccgtacggggttcggggtttaaccgtaccggggtaaaccgggtacgggtaaaaccccggtaagggtttacccccggttaaccccggttacccccgggtaccccgtaaaccggttccccggaaaccccgggaaccccgtaaaaaccccgggtacccccgtaaaccccccgttaaacccggg

SEQ ID NO: 2981 - DNA, 734 bp, Homo sapiens
  misc_feature: GYAE6OF01C1T5C.3.18.B07.1.454.CMB.1.raw
  modified_base (238)..(238): a, c, t, g, unknown or other
  misc_feature (238)..(238): n is a, c, g, or t
  modified_base (278)..(278): a, c, t, g, unknown or other
  misc_feature (278)..(278): n is a, c, g, or t
tcagagacgcactccacgaccggtgctcgatttagtcgctgcgtaaaggaggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatccgcctatcctcctgcacgtggaaccngcagtgacgttggtgttataactatgtctctgtatcaacngccaccgaggaccaaacgacccccaaactcattaattatgatgtacagttaacgtccggtccctgtacgggtttactaacgtcgtctttcgtcgttacggttaacgtacgttcgtacggtacccaaccgtaccgggtccccttacccgtacggaaccctacttccgttaccggtccgggtcccttaccggacgggtaccgtacgggaacgggtaaccggtacggtaccgttaggttaactttaacgtttacgtacggtaccgacggtacctactaacgtaacttaacgaacgaccgaagtaccgacggtacccgtacgggttaccggggttaccggttaccgggtaacggtaccggggtaacccgtaccgggttacccgtacccgggttaccccgtaccccggtacccggtaccgacccggacccccgtaacccggaccccctaaccccgtacccg

SEQ ID NO: 2982 - DNA, 776 bp, Homo sapiens
  misc_feature: GYAE6OF01D3PJK.3.18.B07.1.454.CMB.1.raw
  modified_base (237)..(237): a, c, t, g, unknown or other
  misc_feature (237)..(237): n is a, c, g, or t
tcagagacgcactccacgaccggtgctcgatttagtcgctgcgtaaaggaggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcatcatccgccatctcctgcacgtaggaaccngctaggtgtacggtttggtagttaataactatcgtctccgtaggtatacaacacgaccacccgaacggaaccaaaaccgacccccctaaactactaaatttaaacttttacgtagtagttacgtacgtaagttaactccgggtacccttacggtagggtttactaacgttcgtctttcgttcgttacggttaactaacggtcgtacggaccgtaaccgtacccggtccctacccgtacgtacctacttccgtcgtcgggtacctaccgtacgggtacgtacgggaacgggtacggaggtacgttagttaactttaacgtacgtacgcgtaacgtacctaacgtaacgttaacgtaacgaacgacgtaacgacgtaacggtaccggtacgggttcgggttaccgttaaccggggtaaaccggttacggggaaacccgtaacgggttacccgtaccccgggttaccccgtacccgtaacccggtaccccgaacccggtaaaccccggtaaccccggtaaccccctaaaccccggttacccg

SEQ ID NO: 2983 - DNA, 719 bp, Homo sapiens
  misc_feature: GYAE6OF01B2P68.3.18.B07.1.454.CMB.1.raw
  modified_base (233)..(233): a, c, t, g, unknown or other
  misc_feature (233)..(233): n is a, c, g, or t
  modified_base (324)..(324): a, c, t, g, unknown or other
  misc_feature (324)..(324): n is a, c, g, or t
tcagagacgcactccacgaccggtgctcgatttagtcgctgcgtaaaggaggaaaggggggggtctcaggaggcagcgctctcgggacgtctccaccatggcctggctctgctattcctcaccctcctcactcagggcacgaggtcctgggcccagtctgccctgactcagcctgcctcgtgtctgggtctccgtggacagtcgatcatcgaccatctcctgcactggaaccngcaggtgacgtttggtagttataactatgtctctggtatcaacagccaacccgaggaccaaaaccgacccccaaactctaattaattttangtatcgtactaacgttaacgtccggcccgtaggttacggggttttccttaaagtccttcttcgttacgtacggtttaactaacggttccgtaggtaaccctaaacgtacccggtcccttaccccgtacgaacccttacgtttcccgtacggttcggggtaccctacccgggacgggtaccgtagggaaccgggtaacgggacggttacgttacggttaagtttaacgttaacgtcgacgtacgtctaccgtaattaactacgaacgtcgaacgacacggacgtacgggttgggtaccgttacgggaaccgtacgggaaccgtaagggtccctacccgggtccgtaaccccgacgtacccgacggtaccccgaacggtaccccctaacccgtaccg

SEQ ID NO: 2984 - DNA, 679 bp, Homo sapiens
  misc_feature: GYAE6OF01CUW34.3.18.B07.1.454.CMB.1.raw
  modified_base (236)..(236): a, c, t, g, unknown or other
  misc_feature (236)..(236): n is a, c, g, or t
  modified_base (491)..(491): a, c, t, g, unknown or other
  misc_feature (491)..(491): n is a, c, g, or t
  modified_base (524)..(524): a, c, t, g, unknown or other
  misc_feature (524)..(524): n is a, c, g, or t
tcagagacgcactccacgaccggtgctcgatttagtcgctgcgtaaaggaggaaaggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggactagtcgatcatcgccatctcctgcatggaaaccngcagtgacgttggtgttaataactatgtctcgtaggtatacaacagcacccaggacaaaaccgccccaaatctaattaatttactgtaattcgtactaaggttaactccgggtacccttacgggttaacgggttttactaacgttccgtcctttcgttacgttacggttaacaagttcgtaggaacctaacgaccggtcccttccgtacgaccctattccgtcgtacggtcctacgaggtctagggacggtacgnggcttagtaagttatacgtcgacgacgtcttanaacgtaattaaccgaacgtacaacgcaaggaccgttacgggttcgggttaccgttaacgggtaacggtcgggaacccgttaaggtccctaacccggtcccgtacccgtacgtaccgaaccggaaccccgtacccggtaacccaaccccgttaacg

SEQ ID NO: 2985 - DNA, 553 bp, Homo sapiens
  misc_feature: GYAE6OF01A1D5F.3.18.B07.1.454.CMB.1.raw
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (534)..(534): a, c, t, g, unknown or other
  misc_feature (534)..(534): n is a, c, g, or t
tcagagacgcactccacgaccggtgctcgatttagtcgctgcgtaaaggaggaaaggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggactggtcgatccagtccgccatccgtctgcacgtcggaaccagcagtgacgttggtagttactactangtctcgtgtactcaacancaccgagacaactccccaaatctatattacngtatnactagtaacgtccgtacctacgtacgggttactaacgtccgtcttcctattacgggttacctaagttcgtaaccggctaaacccggtcggtccctccttaacgcctacttcgcgtcgctcgcgcgaggacgacgngtntntatntcncncacntntatacacgacgacagacgacgacgcgtgtcgtcgagacgcgcgtcgtccgcgtacncgcgacgacgacgcgcgac

SEQ ID NO: 2986 - DNA, 583 bp, Homo sapiens
  misc_feature: GYAE6OF01DHVHU.3.18.B07.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
tcagagacgcactccacgaccggtgctcgatttagtcgctgcgtaaaggaggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcatcgcatctcctgcactggaaccngcagtgacgttggtgttaataactatgtctcctggtatcaacagcaccaggcaaacgcccccaaaactcaataatttactagatgtcaagtaatccggccctcgtaggggttttactaatcgctttctctggttacaagtctggacaacgaccggcctccctgaaccattctaccgtgggccttccgagggtcctggaacggacggaggcttagtattactactgacagtctactaatactaacaagtcaagcagcgtacgttcggggttactacgggaacgtcgggaacctaaggtcctaccggtccgtacccacgtaccacgcccgaaacggcccaaaccccgtaccg

SEQ ID NO: 2987 - DNA, 716 bp, Homo sapiens
  misc_feature: GYAE6OF01D5XZQ.3.18.B07.1.454.CMB.1.raw
tcagagacgcactccacgaccggtgctcgatttagtcgctgcgtaaaggaggaaagggggggggtctcaggaggcagcgctctcgggacgtctccaccatggcctgggctctgctattcctcaccctcctcactcagggcacagggtcctgggcccagtctcgccctgactcagcctgcctccgtgtctgggtctcgtggacagtcgatcatccgccatcctcctgcacgtcggaaccagccagtgtacggttggtagttaataactatcgttctccgtggtatacaacacgaccaccgaggaccaaaccgaccccaaactacattaacttatagtactgtcaagttaactcggacctacgtagggttactaagtcgtcttctagtacgtaacagttcgtgactaaccgacgtccctcctacgacctacttccgtcgtcggtacctaccgagggtcgtagggaacggtaacgacggtcctagttaacgtttactaccgttcgactacgtactacgtaaacttaacaaacgaacgtacgaaacgcgtaacggaccgtacgggtttaccggggttaaccgttaaccgggtaacgggtaaccgggtaaacccggttaaacggtcccgttaacccgggtaccccgttaccccgaaaccggttacccgaaaccgggtaacccccgaaacccgggtaacccccctaacccccggttaacccg

SEQ ID NO: 2988 - DNA, 718 bp, Homo sapiens
  misc_feature: GYAE6OF01E53E3.3.18.B07.1.454.CMB.1.raw
tcagagacgcactccacgaccggtgctcgatttagtcgctgcgtaaagggagaaaggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatcatcgccatctcctgcacgtcggaaccagcaggtgtacgtttgggtagttaactaactatcgtctccgtaggtactacaacacgaccaacccgacggaaccaaacccgtacccctaaactactaattaaatttagtgtattacgtactaacgttaacgtccggtaccgttacggtagggtttactaacgttcgttctttacgttacgttacggttaacgtacgttcgtacggtaacctaacccgtacccggtcccttaccgtacgtacctcgttccgtccggtcgggaccgtaccggagggtacgtaacgggacggacggtacggacttagttaatttacgtacgtcgacgtacgtactaagtaactaacgaacgacgtacgagtaccgtacggtacggtacgggttcgggttaccgtacgggaaccgtacgggtaacccgtacgtcccggtacccgtacccgacccgtaccggtaccgacccgaacccgacccgaccctaacccggtccg

SEQ ID NO: 2989 - DNA, 764 bp, Homo sapiens
  misc_feature: GYAE6OF01CSQ59.3.18.B07.1.454.CMB.1.raw
  modified_base (233)..(233): a, c, t, g, unknown or other
  misc_feature (233)..(233): n is a, c, g, or t
tcagagacgcactccacgaccggtgctcgatttagtcgctgcgtaaaggaggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcatggaaccngcagtgacgttggtgttatactatgtctctgtatcaacagccaaccaggacaaacgaccccaaactctaattaatttatagtattcgtacaagtaacgtccgtccctacggttacgggtttactaactcgtcctttcttcgttacggttaacacgttcgtcggaaccaccgaaccggtccccttaccgtacgaacctacgttacccgtcggtcgggtacccttaccgacgggtcccgttagggaaaccgggtacggtagggtaccttaggttaaacgtttaaccgtttacgtacggtactacggttacctactaaacgtttacgtaaaacgtaacgggtaccaagggtacccaacggttccgttaaccgggttccgggggtttaacccttaccgggggtaaccggtacgggtaaaaccccggtaacggttaccccggtaaacccgtttaccccgggtaccccgtaaccggtacccgtaaacccgggaccccgtaaaaccccgggaccccccgtaaaccccgttaaacccgg

SEQ ID NO: 2990 - DNA, 676 bp, Homo sapiens
  misc_feature: GYAE6OF01BJIRD.3.18.B07.1.454.CMB.1.raw
  modified_base (548)..(548): a, c, t, g, unknown or other
  misc_feature (548)..(548): n is a, c, g, or t
  modified_base (585)..(585): a, c, t, g, unknown or other
  misc_feature (585)..(585): n is a, c, g, or t
  modified_base (590)..(590): a, c, t, g, unknown or other
  misc_feature (590)..(590): n is a, c, g, or t
  modified_base (599)..(599): a, c, t, g, unknown or other
  misc_feature (599)..(599): n is a, c, g, or t
tcagagacgcactccacgaccggtgctcgatttagtcgctgcgtaaaggaggaaaggggggggtctcaggaggcagcgctctcgggacgtctccaccatggcctggctctgctattcctcaccctcctcactcgagggcacgagggtcctcgggcccagtctcgccctagactcacgcctcgcctccgtgtcgtgggtctccgtggacagtcgatcactccgcctatcctcctgctacgtacggaaccagcgtaggtcggtacggtttggtacgttaacttaacgttagttcgttccgttccgttaggtaactacaacacgacacgtacgaacggtaacccaaacccgtacccctaaattaccgtaaatttaacgtttagacgtattacgtaacgtaacgttaccgtcccggtaccgttaacggttacggtttactacgtccgttacttcgtacgttagtactagtcgtacgaccacgtccgtacctccgtactactacgtcgtacgtcggtacctacggtcggacgtacggaacgacgtacgtactnttaacgttacgtcgacgactagtctagtaataacganacgancgtacgacncggtggttcgtacggacgtacggcgacgtacgtccgtccgtaccgcgacgtaccgaccgaccgaccgtccgtaaccg

SEQ ID NO: 2991 - DNA, 616 bp, Homo sapiens
  misc_feature: GYAE6OF01EHKFO.3.18.B07.1.454.CMB.1.raw
  modified_base (202)..(202): a, c, t, g, unknown or other
  misc_feature (202)..(202): n is a, c, g, or t
  modified_base (427)..(427): a, c, t, g, unknown or other
  misc_feature (427)..(427): n is a, c, g, or t
  modified_base (456)..(456): a, c, t, g, unknown or other
  misc_feature (456)..(456): n is a, c, g, or t
tcagagacgcactccacgaccggtgctcgatttagtcgctgcgtaaaggaggaaagggggggggtctcaggaggcagcgctcgtcgggacgtctccaccatggcctgggctctgctattcctcaccctcctcactcagggcacagggtcctgggcccagtctgccctgactcagcctgcctccgtgtctgggtctctggacngtcgatcatcgcatctcctgcactaggaaccagcaggtgacggttggtagttaataactagtgtctctggtatacaacagcaccagacaaacgaccccaaactcattaaattatgatgtatagtaacgtccggacctgtagggttactatcgtcttctcgttagttacagtctagcaacgccggtccctcctacgaccattcgtcgtacggcctacgacggtcgnggaacgggacgaggctagtatttactacnggactagtacctacgtacttaacgtaacaagtacacgtacgacgtccgtaacggttcggggttaccttacgggtaacggtacgggaaccgtaacggtaccgtacccggttaccgtacccaccggttcgaaccggacccgaaaccgaccccaacccgtacg

SEQ ID NO: 2992 - DNA, 795 bp, Homo sapiens
  misc_feature: GYAE6OF01C73T2.3.18.B07.1.454.CMB.1.raw
  modified_base (205)..(205): a, c, t, g, unknown or other
  misc_feature (205)..(205): n is a, c, g, or t
  modified_base (229)..(229): a, c, t, g, unknown or other
  misc_feature (229)..(229): n is a, c, g, or t
tcagagacgcactccacgaccggtgctcgatttagtcgctgcgtaaaggaggaaaggggggggtctcaggaggcagcgctctcgggacgtctccaccatggcctggctctgctattcctcaccctcctcactcgagggcacgacgggtcctcgggcccagtctcgccctgactcagcctgcctccgtgtctggtctccgtggacngtcgatcatcgctatcctccgtanccacgtaggaacccaggcctaggtcgtacggtttggttacgttaaagttaacttagttcgttaccgttaccgttagggtacttacgaacctacgaccaccccgaacggaaccgaaaccgtaacccccctaaacgtactaattaactttatacgtacttagtacaacgttacgtccggtaccttacggttaacgggttcacgttcgtacttcgtacgtcgttaacgacgttcgtacgactacgaccggtcctccgtacgacctacgtaccgttcgtccggtaccttacgacggtcgtaggtaacgggaacgtacggtacgtttagttaaccgtttacgtaaccgtcgtaaccgtaccgtttacgaacgttaactacgtaaaccggtacggtacgtaaccggtccgtaaggtccggttaaccgggtttaccggtaccggttacgggtaacccggtaacgggttaaaccccgtggttaccccggtacccggtttaccgggaacccctttaacccggaccggttaccccaaaccccggtcccgggttaaacccacccccgggtttaaccg

SEQ ID NO: 2993 - DNA, 629 bp, Homo sapiens
  misc_feature: GYAE6OF01BPFCB.3.18.B07.1.454.CMB.1.raw
  modified_base (231)..(231): a, c, t, g, unknown or other
  misc_feature (231)..(231): n is a, c, g, or t
  modified_base (446)..(446): a, c, t, g, unknown or other
  misc_feature (446)..(446): n is a, c, g, or t
tcagagacgcactccacgaccggtgctcgatttagtcgctgcgtaaaggaggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatctctgcactggaaccngcagtgacgttggtgttataactatgtctctggtatcaacagcaccaggacaaacgacccccaaactcattaatttactgatgtcagttaattcgccctgtagggtttctaatcgtcttctcttaggttacaagtctgacaacgccggtcctcctcgacctatctcgtcggcctccgaggtcgtaggacggacgtaggctaggtatttagttacncgacgtcgctacgattactaacgaacgtacaagtacgacgtccgtaaggttcggggttaccgttaacgggtaaccgtacgggaacccgttaagggtccccgttaacccggtcccgtaccccgtaacccggtaccgtacccggtaacccccgaaaccggtacccccctaaacccccgtaacccg

SEQ ID NO: 2994 - DNA, 755 bp, Homo sapiens
  misc_feature: GYAE6OF01D90JJ.3.18.B07.1.454.CMB.1.raw
  modified_base (252)..(252): a, c, t, g, unknown or other
  misc_feature (252)..(252): n is a, c, g, or t
  modified_base (271)..(271): a, c, t, g, unknown or other
  misc_feature (271)..(271): n is a, c, g, or t
  modified_base (562)..(562): a, c, t, g, unknown or other
  misc_feature (562)..(562): n is a, c, g, or t
  modified_base (691)..(691): a, c, t, g, unknown or other
  misc_feature (691)..(691): n is a, c, g, or t
tcagagacgcactccacgaccggtgctcgatttagtcgctgcgtaaaggaggaaaggggggggtctcgaggaggcagcgctcgtcgggacgtctccaccatcggccgtggctctgcttattcctcactcctcctcactcgacggcacgtacgggtcctcgggccctagtctcgcccctgacctcgagtcctcgtcccttcgtcgtcgtcggtcctcgtaggacagtcgatcgactccgactacttccgtccncgtccaacgtacggaaccngcgtaggttggtaacggttggttacgttaaattacgtagttacgtccgttaccgtagttaacaccgaaactccgaacccaaccggaacgaacccctaaaacccgaaccccttaactatttaaaacctttaagtttagacgttacgttacgttaacgtaaaccggtttaaccgtacccggttccgtaagggttttaacgttaactaccgttcgttacttcgttagttacgtaacgtcgtagtacgaccaccgtccgtcctacgtactacctatccgtcggacgtctacgtgngtacggagtcgagtgtacgttagtcgtacgtactacgacactagaataaccgaggtactacgcgaacgacggtccggtacgggtcggtttacgaaccggtacggtacccgtaaggtacccggtaacccncccggttacccaacccgaccgttaacccgaccccggttaaacccggcccgtaacccctaaccgg

SEQ ID NO: 2995 - DNA, 814 bp, Homo sapiens
  misc_feature: GYAE6OF01B6LKS.3.18.B07.1.454.CMB.1.raw
tcagagacgcactccacgaccggtgctcgatttagtcgctgcgtaaaggaggaaaggggggggtctcaggaggcagcgctctcgggacgtctccaccatggcctggctctgctattcctcaccctcctcactcagggcacgagggtcctgggcccagtctgccctgactcagcctgccctccgtgtcgtgggtcctccgtggacagtcgatcatccgcctatcctcctgcctaagtcgggaaccagccaggtgacggtttggtagttataactatcgtctcgtggtatacgaacagaccaccgaggacaaaccgacccctaaatctaattaattatagtactgtacctaagtacgtccggtacctaggttaacgggtttactaacgtcgttcttacgttcgttaggttaacaacggttcgtacgaaccgtaaaccgtcccggtaccttaccccgtacgtaaccctcgttccgtaccggttcgggtacccttaccgggaacggttcggtacgggaacgtaacggggtacggttaccgttagttaaacgttttacgtttaacccgagtacggtaactaccttaactaacgtttaaacgtaaccgaagtaccgaaccgaccgttacgggaccgtttaacggggtaccgggggtttacgtaaacccgggggttaaccggtttaaccgggaaacccggttaacggggttacccccgaacccggggttttacccccgtaccccggtaaacccgggtacccgtaaacccgggtaacccccggaaaccccgggttaaacccccaaaccccccggttaaccgg

SEQ ID NO: 2996 - DNA, 713 bp, Homo sapiens
  misc_feature: GYAE6OF01A6GOO.3.18.B07.1.454.CMB.1.raw
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
tcagagacgcactccacgaccggtgctcgatttagtcgctgcgtaaaggaggaaagggggggggtctcaggaggcagcgctctcgggactctccaccatggcctggctctgctattcctcaccctcctcactcagggcacgagggtcctggggcccagtctcgccctgactcagcctgcctccgtgtctgggtctcctggacaggtcgatcactccgccatcctcctgacctacgtggaaaccacggtcaggttcgaacggtttgggtagttaactaacgtatgtactcctagtatacaacgngaccaccaggaccaaacgaccccaaactctaattaattangtacttagactaggtaaactccggtaccctaggtacgggtttaataactcgctttcttacgtaggtaactaagtccgtagacctaaccgacggtcccctaccgtacgaacctacttcgtcgtaccgggtcctacggtacggcgtacggaacgggaacggcggtacttaaggtaactttaagttaccgtaggactaacgtacgtaacttaaataacgttaaccgaacgtaccgacgaactacggtacgtacggttacgggttaccgttaaccggggtaacgtaaccgggaacggtaaccggtacccgtacccggtaccgtacccgtaacgtacgaacccgtaccgaaaccggaccccctaaccggtaaccg

SEQ ID NO: 2997 - DNA, 647 bp, Homo sapiens
  misc_feature: GYAE6OF01BEBQE.3.18.B07.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (287)..(287): a, c, t, g, unknown or other
  misc_feature (287)..(287): n is a, c, g, or t
  modified_base (325)..(325): a, c, t, g, unknown or other
  misc_feature (325)..(325): n is a, c, g, or t
  modified_base (466)..(466): a, c, t, g, unknown or other
  misc_feature (466)..(466): n is a, c, g, or t
tcagagacgcactccacgaccggtgctcgatttagtcgctgcgtaaaggaggaaaggggggggtctcaggaggcagcgctctcgggacgtctccaccatggcctgggctctgcttattcctcaccctcctcactcagggcacgagggtcctgggcccagtctgccctgactcagcctgcctccgtgtctgggtctcctggacngtcgatcatcgccatctcctagcactacggaaccngcagtgtacgtttggtagttataacgtatgtctcgtaggtactacaacngacaccgaggaccaaacgaccccaaatcaataacttanagtattgtactaagtaacgtccgtcctagtacgggttactaagtcgtcttctcgttacgttacagtctacggacgtaaccgacgtcccgttacctacgaacctctcgttcgtcggacctacgagtccgtaggaacggacgnggactagtattatacgtgtacacgctagtaactactaacgagtcgagacgtacgtaccgtaacggttcggggttaccgttacgggtaacgtccgggtaaaccttacgggaccgttacccggtaccggtccccaacggttcccgaaccggtaaccccgaaccgtaccccgtaacccgtaccg

SEQ ID NO: 2998 - DNA, 815 bp, Homo sapiens
  misc_feature: GYAE6OF01CEPHA.3.18.B07.1.454.CMB.1.raw
tcagagacgcactccacgaccggtgctcgatttagtcgctgcgtaaaggaggaaaggggggggtctcaggaggcagcgctcgtcgggacgtctccaccatggcctgggctctgctattcctcaccctcctcactcgagggcacgagggtcctgggcccagtctgccctgactcagcctgcctcgtgtcgtgggtctctggacagtcgatcatccgccatctcctgcacgtcgaaccagctagtgacggttggttacggtaataacgtattcgtcgtccgtggttaactacaacgtacgaccacccgaaggaccaaaccgaaccccccctaaactactaatttaaacgtttacgtagtattagtactaacggtaaacgtcccgggtacccttagggttaaccgggttttactaacgtttaccggttccgttacgtttacgtttacgggttaacctaacgggtttccgtacgggtaacccaaccggtaacccgggtccccttccccgttaacggaacccttacgttccgttaccggttcgggtacccgttacccggtaacgggtccgttaacgggaacgggtaacgggtacgggtacgttacgttaagtttaacgttaaccggttggaaccgtacgtaaccgtaaccgtaagttaacttaacgaaaacgttccgaacgtaccgtaacgccgggttaacgggttcggggttaccgtttaccgggaaccggttacgggtaacccgtacgggtaccgtccccggtccgtaaccccgacgttacccgaccgacccgaacccggacccaacccgttaacccg

SEQ ID NO: 2999 - DNA, 748 bp, Homo sapiens
  misc_feature: GYAE6OF01D4JNY.3.18.B07.1.454.CMB.1.raw
  modified_base (123)..(123): a, c, t, g, unknown or other
  misc_feature (123)..(123): n is a, c, g, or t
  modified_base (135)..(135): a, c, t, g, unknown or other
  misc_feature (135)..(135): n is a, c, g, or t
  modified_base (151)..(151): a, c, t, g, unknown or other
  misc_feature (151)..(151): n is a, c, g, or t
  modified_base (164)..(164): a, c, t, g, unknown or other
  misc_feature (164)..(164): n is a, c, g, or t
  modified_base (261)..(261): a, c, t, g, unknown or other
  misc_feature (261)..(261): n is a, c, g, or t
  modified_base (530)..(530): a, c, t, g, unknown or other
  misc_feature (530)..(530): n is a, c, g, or t
  modified_base (582)..(582): a, c, t, g, unknown or other
  misc_feature (582)..(582): n is a, c, g, or t
  modified_base (605)..(605): a, c, t, g, unknown or other
  misc_feature (605)..(605): n is a, c, g, or t
tcagagacgcactccacgaccggtgctcgatttagtcgctgcgtaaaggaggaaaggggggggtctcaggaggcagcgctcgtcgggacgtctccaaccatggccctgggctctgctattccncaccctctcacncagggcacgagggtcngggacccagttcncgccctgactcgacgtcctgacctcgtgtcgtcggtctccgtggacagtcgatcgactccgacctattcccgtacgtcacctaacgtaaccgaaccnggactaaggtcggttacggttaggtagtttaaactaaccttagttccgttccttccggtagttaacctacgaaacctacgaacccctaacccggaacggtaaccccaaaacccggaacccccctaaatacgtaattttaaccgtttaagacgtacttaacgtacgtaaagttaacccggtccgtaccttagggttaacgttactacgtcgtccgttctacgttagttacctagtcgtaccgacaaccggtccgtcctacgcgaacttcncgtcgtcgcacgaggctaggacggtaacggctagttacgtaatttcggtacncggtaatccgtaataccgttaanaacgtacagaactacgtacgtacgtcggttcggtaaccgggttacaccgggtaaacgttccgggtaaacggtacggttaccctaccggtccggtaccgtaaccgaccgaacccggtaacccgaaaccgtaccccgaacccgtg

SEQ ID NO: 3000 - DNA, 553 bp, Homo sapiens
  misc_feature: GYAE6OF02I8A7F.3.18.B07.1.454.CMB.1.raw
  modified_base (231)..(231): a, c, t, g, unknown or other
  misc_feature (231)..(231): n is a, c, g, or t
  modified_base (327)..(327): a, c, t, g, unknown or other
  misc_feature (327)..(327): n is a, c, g, or t
  modified_base (346)..(346): a, c, t, g, unknown or other
  misc_feature (346)..(346): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagagacgcactccacgaccggtgctcgatttagtcgctgcgtaaaggaaggaaaggggggtctcaggaggcagcgctctcgggacgtctccacatggcctgggctctgctattcctcaccctcctcactcagggcacagggtcctgggcccagtctgccctgactcagcctgcctccgtgtctgggtctcctggacagtcgatcatcgccatctcctgcactggaaccngcagtgacgttgggtgttaataactatgtctcctggtaatcaacagcaccaggcaaagcccccaaatcataattatgatgtcagtaatcggccctnagggtttcaatcgcttctntggttacaagtctggcaacacggcctccctgaccatcctctcgggctccaggtctgaacggcgaggctgatttagtactgcngcctnatatacgaacgcagcgacgacaacgtggggttctacgggaacgtcgggaacctaaagggtcctaaccggtccgttacccgaacggttcaaccggcccaaacgggccccaaccccgtaccg

SEQ ID NO: 3001 - DNA, 687 bp, Homo sapiens
  misc_feature: GYAE6OF02JRPX7.3.18.B07.1.454.CMB.1.raw
tcagagacgcactccacgaccggtgctcgatttagtcgctgcgtaaaggaggaaaggggggtctcaggaggcagcgcgtctcgggacgtctccaccatggcctgggcctctgctattcctcaccctcctcactcaggcacagggtcctggcccaggtctgccctgactcagcctgcctccgtgtctgggtctcctggacagtcgatcatcgccatctcctgcactggaaccagcagtgacgttggtgttataactatgtctccgtgttactactaacagaccacccgaggaccaaaccgacccccaaactacctaattaaatttagtcgtattacgtactaagttaacgtccggtaccttacggttacggggtttacttaacgtccgtcgttcctcgttacggttacgtaagttcgtggactaacgtccggtccctaccctagtaccctatccgtccgtacggtccttaccgaggtctacggacggacggtaggccgttaggttatttacgtacgtcggactacgtcttactacgttaagtaccgaagtcctaagtcgaacgtaccgtacggttggggtaccttacgggaacgttaccgggtaaccgtaaggttcccgtaaccggttcccggttacccgtaacggtccgaaccgtaccccgaacgggttaccccaaccccgttacgg

SEQ ID NO: 3002 - DNA, 650 bp, Homo sapiens
  misc_feature: GYAE6OF02HGTJT.3.18.B07.1.454.CMB.1.raw
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
tcagagacgcactccacgaccggtgctcgatttagtcgctgcgtaaaggaggaaaggggggggtctcaggaggcagcgctctcgggacgtctccaccatggcctgggctctgctattcctcaccctcctcactcagggcacagggtcctgggcccagtcctgccctgactcagcctgcctccgtgtctgggtctcgtggacagtcgatcatcgccatctctgcactggaaccngcagtgacgttggtgttataactatgtctctggtatcaacngacaccagcaacgaccccaaactcataattatgatgtnagtaatccggtcctcgtaggggtttctaagtccgtcttctntacggttatacgtctaggacaaccgccgacctcccgtacgacctctacctcgtcggtcctaccgaggtcctaggacggacgtagtgtcgttaatttacgttacgtcgtcacgtcttacattaacgtacaagtacccgaagtaccgtaaggacctacgggttcggggttacccggttaccgggaacgttaaccggggaacccggttaaacgggtacccgtaaccccggttcccgttacccgtacccggttaccgtacccggaaaccccgaaccgggtacccctaaacccccgtaccgg

SEQ ID NO: 3003 - DNA, 860 bp, Homo sapiens
  misc_feature: GYAE6OF02JBN4O.3.18.B07.1.454.CMB.1.raw
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
tcagagacgcactccacgaccggtgctcgatttagtcgctgcgtaaaggaggaaaggggggggtctcaggaggcagcgctctcgggacgtctccaccatcggcctgggctctgctattcctcaccctcctcactcagggcacgagggtcctgggcccagtctgccctgactcgagcctgcctcgtgtctgggtctctggacngtcntcatcgcatcctccngctacgtacggaaccagcgtagtggtacggttggtacgttaactaacgtattcgtccttccgttaggtaactacaaacgtacgacccgaacccgaggaaccaaacccgaacccccctaaaactaccgtaatttaaactttactacgtaattacgttacgtaaagttaaccgtacccgggtacccttacggttaacggggttttacttaaacgttccggttacctttccgttacggttacgttaaccgtaaggttccgtacggtaaccaaccgtacccggtacccttcccgtaacgtacccgtacgtttaccgtccggttaccgggtcctacccggtcgggtaaccttacggggaaccggtacgggtaacggtccctttaagggttaattttaaaccggttccgtacggtaacccgtaaccggttacctaaacttaacggttaaaccttaacccgaaacgtccggaaaccgtacgaccggtaacccggttagggtttacccggggtttacccttaccggggtaaccggttacccgggaaacccgttaaaccggtcccggtaaccccggttaccccgtacccggtacccggttaacccgacccggtaacccgaacccccggtaccctaaaccccgttaccg

SEQ ID NO: 3004 - DNA, 672 bp, Homo sapiens
  misc_feature: GYAE6OF02GKRPS.3.18.B07.1.454.CMB.1.raw
tcagagacgcactccacgaccggtgctcgatttagtcgctgcgtaaaggaggaaaggggggggtctcaggaggcagcgctctcgggacgtctccaccatggcctgggctctgctattcctcaccctcctcactcaggcacagggtcctgggcccagtctgccctgactcagcctgcctcgtgtctgggtctcctggacagtcgatcatcgccatctcctgcactacggaaccagcagtcgacgttggtgttataactatcgtctacctggtactcaacgagaccaccaggaccaaaccgacccccaaactacctaattaactttatacgtagttcgtactaacgttaacgtccggacccgttcgtaacggggttttactaacgttccgtacttcgtacgttacggttaacctaaggttccgtaggacctaaccgccggtaccctacccgtacgacctacgtctacggtcggctccgtaggtccgtaggtacggacggtaggtcgtaggtatttacttacgtatacgactactacacttaataaccgacgtcacgtacgacgaccgtacgtacgggttctacgggtaacgtacgggtaaccgtaacgtccgtacccggttccgtacccgtaccgttaccggccggtaaccccgacggtaccccaaccctaccg

SEQ ID NO: 3005 - DNA, 707 bp, Homo sapiens
  misc_feature: GYAE6OF02JXRTI.3.18.B07.1.454.CMB.1.raw
  modified_base (239)..(239): a, c, t, g, unknown or other
  misc_feature (239)..(239): n is a, c, g, or t
tcagagacgcactccacgaccggtgctcgatttagtcgctgcgtaaaggaggaaaggggggggtctcaggaggcagcgctctcgggacgtctccacatggcctgggctctgctattcctcaccctcctcactcagggcacgagggtcctgggcccagtctgccctgactcagcctgcctccggtgtcgtgggtcctcctggacagtcgatcatcgcctatctctgcaacgtggaaaccngcagtgacggtttgtagttaataagtatgtctctagtatacaacacgacaccgaggaccgaaaccgaaccccaaacctactaacttaaattaatagtaagtagtaacgtaagttaaacgtccgtaccgtacggttcgggttaaaaaaaaaactctacgttcttacgtacgttacggttaacgtaacgtcgtacgtacgtaaccgtaacccggtaccctacccgtaccgtacctacgtaccgttacggtacggtaccgtccgtaggtacgtaggaacggtaacgtacggtcgtaaggttaacttaagttaacgtacgacgtacgtcgttaactaataacgtaactacgacgaacgtacgacgtacgtaggtacggttacgtacgtacgtacgggtaacgaacgttaccggtaaccgtaccggtaccgtaacggtaccgaccgtacccgaacccgacccgtaaccctacg

SEQ ID NO: 3006 - DNA, 1140 bp, Homo sapiens
  misc_feature: GYAE6OF02ILIKF.3.18.B07.1.454.CMB.1.raw
tcagagacgcactccacgaccggtgctcgatttagtcgctgcgtaaaaggaggaaaagggggggggtctcgaggaggcagcgctcgtcgggacgtctccaccatggcctgggctctgctattcctcacccgtcctcgactcgaggtcacgaggtcctcgggccctagtctccgcctgacctacgacgtcctcgtcccgtcgtcgttcggtcgggttcctccggtacggaacgtggtaccataccgacgtcccgacctactccttccgtcgaccgtacgtaccggaaaccgacgtaccggtaacgggttcggttacgggtttacggggtttaactttaaacgtaaaacgttacgtttacggttacccgtttaccggttaacgggttaacgtaaccgtaaaaccgccgtaaacccgtaacccggtaaacgggaaaacccgttaaaacccccgaaaccccgttaaacctaacggtttaaaaacttttaaacttacggtaacgtttaacgtccggttaaacgttaaacccgggttaaacgttccccgggttaaacccggttacgggtttaaaccggggttaacctttaaccggtcccgttttaaccgtttccgtttaacgggttaaccggttaaaaccgttcgggttacggtaaaccgtaaccccgggtaaacccgttaacccggttacccccttaccggtaacccggtaaaccttcccgtttacccggttccggggtacccgttaaccgttaaccggaaccggtagggaaacccgggtaacgggtaccggtaaccgggtacgtttaaaacgttaaccgttttacgtaaccgttaccgggtacgttaccggtaaacccgttaaagtttactaaaacccgggttaaaccgtaaacccgggacggttaaacccggttaacggttaaaccggggttaccggttaaacccggggtttacccggggttaaaccgttaaaccgggggtttaaacccggttaacccggggaaaccggttttaacccccggggccggttttaaccccggggtttaaccccgtaaccccgggttaacccgaacccggtttaaaccccccggggacccggtttaaacccccgggtaaccccccgttaacccggtttaaccccgg

SEQ ID NO: 3007 - DNA, 165 bp, Homo sapiens
  misc_feature: GYAE6OF01BTWHW.1.55.E11.1.454.CMB.1.raw
  modified_base (157)..(165): a, c, t, g, unknown or other
  misc_feature (157)..(165): n is a, c, g, or t
tcagacgagtgcgtcacgaccggtgctcgatttagcactcgcacggttgggtttgggggaagaggaagactgacggtcctgccacagcggccctgggctgcctggtcaaggactacttcccacgcactcgtctgagcgggctggcaaggcgcatagnnnnnnnnn

SEQ ID NO: 3008 - DNA, 712 bp, Homo sapiens
  misc_feature: GYAE6OF02FH6XR.1.55.E11.1.454.CMB.1.raw
tcagacgagtgcgtcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcctccatcactcctgtctgcatctgtcggagacagatccacctattacttgaccgtacagtcacgactaataaacttacttttaaatgtatcagacaacgaaaccgacgggaacgaccccaagtcctctagactcgtatcggtctgactactacgtaagttagagtacggtcgggtacctacgtccgaggttcgaggtcggacgtagtacggtactacgggtacgtaacttaacgtttccaccttccgtaaccaccgttactccgaacgtccgtacgtctacgaacctaaccggtaaggtaacgtttacgtttacaaacctttaactttaacttagttaccgtaaacctaacgggttaacttacgtttaaaccgttacgttttaccttttaacccgtttaccgttaccgtttacccgggttacccggtttaccggtaacggttaccgtaacgttacgtaaaccgtaaacccggttaaacgtaaaccggttacggtaccggttacgttaccgaacccgtactaccgtttaccgtcgttttaaccc

SEQ ID NO: 3009 - DNA, 172 bp, Homo sapiens
  misc_feature: GYAE6OF01BMJQR.30.86.H09.1.454.CMB.1.raw
  modified_base (172)..(172): a, c, t, g, unknown or other
  misc_feature (172)..(172): n is a, c, g, or t
tcagcacgctacgtcacgaccggtgctcgatttagtgctatagacttgggtttgggtgtcttcggcggagggaccaagctgaccgtccttcgtcagcccaaggctgcccctcggtcactctgttcccgccctcctcacgtagcgtgctgagcgggctggcaaggcgcatagn

SEQ ID NO: 3010 - DNA, 176 bp, Homo sapiens
  misc_feature: GYAE6OF01CAP6C.30.86.H09.1.454.CMB.1.raw
  modified_base (172)..(176): a, c, t, g, unknown or other
  misc_feature (172)..(176): n is a, c, g, or t
tcagcacgctacgtcacgaccggtgctcgatttagtgctatagacttgggtttgggtgtcttcggcggagggaccaagctgaccgtccttcgtcagcccaaggctgcccctcggtcactctgttcccaccctcctcacgtagcgtgctgagcgggctggcaaggcgcatagnnnnn

SEQ ID NO: 3011 - DNA, 172 bp, Homo sapiens
  misc_feature: GYAE6OF01B4TBK.30.86.H09.1.454.CMB.1.raw
  modified_base (172)..(172): a, c, t, g, unknown or other
  misc_feature (172)..(172): n is a, c, g, or t
tcagcacgctacgtcacgaccggtgctcgatttagtgctatagacttgggtttgggtgtcttcggcggagggaccaagctgaccgtccttcgtcagcccaaggctgcccctcggtcactctgttcccaccctcctcacgtagcgtgctgagcgggctggcaaggcgcatagn

SEQ ID NO: 3012 - DNA, 173 bp, Homo sapiens
  misc_feature: GYAE6OF01DXNNG.30.86.H09.1.454.CMB.1.raw
  modified_base (172)..(173): a, c, t, g, unknown or other
  misc_feature (172)..(173): n is a, c, g, or t
tcagcacgctacgtcacgaccggtgctcgatttagtgctatagacttgggtttgggtgtcttcggcggagggaccaagctgaccgtccttcgtcagcccaaggctgcccctcggtcactctgttcccaccctcctcacgtagcgtgctgagcgggctggcaaggcgcatagnn

SEQ ID NO: 3013 - DNA, 172 bp, Homo sapiens; identical to SEQ ID NO: 3009
  misc_feature: GYAE6OF01DZ2MO.30.86.H09.1.454.CMB.1.raw
  modified_base (172)..(172): a, c, t, g, unknown or other
  misc_feature (172)..(172): n is a, c, g, or t

SEQ ID NO: 3014 - DNA, 174 bp, Homo sapiens
  misc_feature: GYAE6OF01DQV0K.30.86.H09.1.454.CMB.1.raw
  modified_base (172)..(174): a, c, t, g, unknown or other
  misc_feature (172)..(174): n is a, c, g, or t
tcagcacgctacgtcacgaccggtgctcgatttagtgctatagacttgggtttgggtgtcttcggcggagggaccaagctgaccgtccttcgtcagcccaaggctgcccctcggtcactctgttcccgccctcctcacgtagcgtgctgagcgggctggcaaggcgcatagnnn

SEQ ID NO: 3015 - DNA, 173 bp, Homo sapiens; identical to SEQ ID NO: 3012
  misc_feature: GYAE6OF01DJDFC.30.86.H09.1.454.CMB.1.raw
  modified_base (172)..(173): a, c, t, g, unknown or other
  misc_feature (172)..(173): n is a, c, g, or t

SEQ ID NO: 3016 - DNA, 183 bp, Homo sapiens
  misc_feature: GYAE6OF01BW5Y9.30.86.H09.1.454.CMB.1.raw
  modified_base (173)..(183): a, c, t, g, unknown or other
  misc_feature (173)..(183): n is a, c, g, or t
tcagcacgctacgtcacgaccggtgctcgatttagtgctatagacttgggtttgggtgtcttcggcggagggaccaagctgaccgtccttcgtcagcccaaggctgccccctcggtcactctgttcccaccctcctcacgtagcgtgctgagcgggctggcaaggcgcatagnnnnnnnnnnn

SEQ ID NO: 3017 - DNA, 172 bp, Homo sapiens; identical to SEQ ID NO: 3011
  misc_feature: GYAE6OF01AXICK.30.86.H09.1.454.CMB.1.raw
  modified_base (172)..(172): a, c, t, g, unknown or other
  misc_feature (172)..(172): n is a, c, g, or t

SEQ ID NO: 3018 - DNA, 173 bp, Homo sapiens; identical to SEQ ID NO: 3012
  misc_feature: GYAE6OF01A2ELG.30.86.H09.1.454.CMB.1.raw
  modified_base (172)..(173): a, c, t, g, unknown or other
  misc_feature (172)..(173): n is a, c, g, or t

SEQ ID NO: 3019 - DNA, 172 bp, Homo sapiens; identical to SEQ ID NO: 3011
  misc_feature: GYAE6OF01EJO23.30.86.H09.1.454.CMB.1.raw
  modified_base (172)..(172): a, c, t, g, unknown or other
  misc_feature (172)..(172): n is a, c, g, or t

SEQ ID NO: 3020 - DNA, 176 bp, Homo sapiens; identical to SEQ ID NO: 3010
  misc_feature: GYAE6OF01AWI4R.30.86.H09.1.454.CMB.1.raw
  modified_base (172)..(176): a, c, t, g, unknown or other
  misc_feature (172)..(176): n is a, c, g, or t

SEQ ID NO: 3021 - DNA, 189 bp, Homo sapiens
  misc_feature: GYAE6OF01EJ6EX.30.86.H09.1.454.CMB.1.raw
  modified_base (119)..(119): a, c, t, g, unknown or other
  misc_feature (119)..(119): n is a, c, g, or t
  modified_base (134)..(134): a, c, t, g, unknown or other
  misc_feature (134)..(134): n is a, c, g, or t
  modified_base (183)..(189): a, c, t, g, unknown or other
  misc_feature (183)..(189): n is a, c, g, or t
tcagcacgctacgtcacgaccggtgctcgatttagtgctatagacttgggtttgggtgtcttcggcggagggaccaagctgaccgtccttcgtcagcccaaggctgcgccgtcgcactnttcgtcccaccctcncacgtgcgtgcgtagacggccgggtcgtggacgaaggccgacaagtagnnnnnnn

SEQ ID NO: 3022 - DNA, 213 bp, Homo sapiens
  misc_feature: GYAE6OF01DF9EA.30.86.H09.1.454.CMB.1.raw
  modified_base (175)..(213): a, c, t, g, unknown or other
  misc_feature (175)..(213): n is a, c, g, or t
tcagcacgctacgtcacgaccggtgctcgatttagtgctatagacgttgggtttggggtgtcttcggcggagggaccaagctgaccggtccttcgtcagcccaaggctgcccctcggtcactctgttcccaccctcctcacgtagcgtgctgagcgggctggcaaggcgcatagnnnnnnnnnnnnnnnnnnnnnnnnnnnnnnnnnnnnnnn

SEQ ID NO: 3023 - DNA, 174 bp, Homo sapiens
  misc_feature: GYAE6OF01BFM4A.30.86.H09.1.454.CMB.1.raw
  modified_base (172)..(174): a, c, t, g, unknown or other
  misc_feature (172)..(174): n is a, c, g, or t
tcagcacgctacgtcacgaccggtgctcgatttagtgctatagacttgggtttgggtgtcttcggcggagggaccaagctgaccgtccttcgtcagcccaaggctgcccctcggtcactctgttcccaccctcctcacgtagcgtgctgagcgggctggcaaggcgcatagnnn

SEQ ID NO: 3024 - DNA, 172 bp, Homo sapiens; identical to SEQ ID NO: 3011
  misc_feature: GYAE6OF01DVNYM.30.86.H09.1.454.CMB.1.raw
  modified_base (172)..(172): a, c, t, g, unknown or other
  misc_feature (172)..(172): n is a, c, g, or t

SEQ ID NO: 3025 - DNA, 174 bp, Homo sapiens; identical to SEQ ID NO: 3023
  misc_feature: GYAE6OF01BHTLK.30.86.H09.1.454.CMB.1.raw
  modified_base (172)..(174): a, c, t, g, unknown or other
  misc_feature (172)..(174): n is a, c, g, or t

SEQ ID NO: 3026 - DNA, 177 bp, Homo sapiens
  misc_feature: GYAE6OF01CKDIJ.30.86.H09.1.454.CMB.1.raw
  modified_base (173)..(177): a, c, t, g, unknown or other
  misc_feature (173)..(177): n is a, c, g, or t
tcagcacgctacgtcacgaccggtgctcgatttagtgctatagacttgggtttgggtgtcttcggcggagggaccaagctgaccgtccttcgtcagcccaaggctgccccctcggtcactctgttcccgccctcctcacgtagcgtgctgagcgggctggcaaggcgcatagnnnnn

SEQ ID NO: 3027 - DNA, 173 bp, Homo sapiens
  misc_feature: GYAE6OF01B0Y08.30.86.H09.1.454.CMB.1.raw
  modified_base (172)..(173): a, c, t, g, unknown or other
  misc_feature (172)..(173): n is a, c, g, or t
tcagcacgctacgtcacgaccggtgctcgatttagtgctatagacttgggtttgggtgtcttcggcggagggaccaagctgaccgtccttcgtcagcccaaggctgccccctcggtcactctgttcccaccctcctcacgtagcgtgtgagcgggctggcaaggcgcatagnn

SEQ ID NO: 3028 - DNA, 175 bp, Homo sapiens
  misc_feature: GYAE6OF01DJARR.30.86.H09.1.454.CMB.1.raw
  modified_base (172)..(175): a, c, t, g, unknown or other
  misc_feature (172)..(175): n is a, c, g, or t
tcagcacgctacgtcacgaccggtgctcgatttagtgctatagacttgggtttgggtgtcttcggcggagggaccaagctgaccgtccttcgtcagcccaaggctgcccctcggtcactctgttcccgccctcctcacgtagcgtgctgagcgggctggcaaggcgcatagnnnn

SEQ ID NO: 3029 - DNA, 173 bp, Homo sapiens
  misc_feature: GYAE6OF01D5HWO.30.86.H09.1.454.CMB.1.raw
  modified_base (173)..(173): a, c, t, g, unknown or other
  misc_feature (173)..(173): n is a, c, g, or t
tcagcacgctacgtcacgaccggtgctcgatttagtgctatagacttgggtttgggtgtcttcggcggagggaccaagctgaccgtccttcgtcagcccaaggctgccccctcggtcactctgttcccaccctcctcacgtagcgtgctgagcgggctggcaaggcgcatagn

SEQ ID NO: 3030 - DNA, 175 bp, Homo sapiens
  misc_feature: GYAE6OF01DF7UP.30.86.H09.1.454.CMB.1.raw
  modified_base (173)..(175): a, c, t, g, unknown or other
  misc_feature (173)..(175): n is a, c, g, or t
tcagcacgctacgtcacgaccggtgctcgatttagtgctatagacttgggtttgggtgtcttcggcggagggaccaagctgaccgtccttcgtcagcccaaggctgccccctcggtcactctgttcccaccctcctcacgtagcgtgctgagcgggctggcaaggcgcatagnnn

SEQ ID NO: 3031 - DNA, 175 bp, Homo sapiens; identical to SEQ ID NO: 3030
  misc_feature: GYAE6OF01CU3UX.30.86.H09.1.454.CMB.1.raw
  modified_base (173)..(175): a, c, t, g, unknown or other
  misc_feature (173)..(175): n is a, c, g, or t

SEQ ID NO: 3032 - DNA, 174 bp, Homo sapiens
  misc_feature: GYAE6OF01D1X9L.30.86.H09.1.454.CMB.1.raw
  modified_base (173)..(174): a, c, t, g, unknown or other
  misc_feature (173)..(174): n is a, c, g, or t
tcagcacgctacgtcacgaccggtgctcgatttagtgctatagacttgggtttgggtgtcttcggcggagggaccaagctgaccgtccttcgtcagcccaaggctgccccctcggtcattctgttcccaccctcctcacgtagcgtgctgagcgggctggcaaggcgcatagnn

SEQ ID NO: 3033 - DNA, 173 bp, Homo sapiens
  misc_feature: GYAE6OF01DVQDP.30.86.H09.1.454.CMB.1.raw
  modified_base (172)..(173): a, c, t, g, unknown or other
  misc_feature (172)..(173): n is a, c, g, or t
tcagcacgctacgtcacgaccggtgctcgatttagtgctatagacttgggtttgggtgtcttcggcggagggaccaagctgaccgtccttcgtcagcccaaggctgccccctcggtcactctgttcccgccctcctcacgtgcgtgctgagcgggctggcaaggcgcatagnn

SEQ ID NO: 3034 - DNA, 179 bp, Homo sapiens
  misc_feature: GYAE6OF01B4WN4.30.86.H09.1.454.CMB.1.raw
  modified_base (174)..(179): a, c, t, g, unknown or other
  misc_feature (174)..(179): n is a, c, g, or t
tcagcacgctacgtcacgaccggtgctcgatttagtgctatagacttgggtttgggtgtcttcggacggagggaccaagctgaccgtccttcgtcagcccaaggctgccccctcggtcactctgttcccaccctcctcacgtagcgtgctgagcgggctggcaaggcgcatagnnnnnn

SEQ ID NO: 3035 - DNA, 174 bp, Homo sapiens
  misc_feature: GYAE6OF01EY880.30.86.H09.1.454.CMB.1.raw
  modified_base (173)..(174): a, c, t, g, unknown or other
  misc_feature (173)..(174): n is a, c, g, or t
tcagcacgctacgtcacgaccggtgctcgatttagtgctatagacttgggtttgggtgtcttcggcggagggaccaagctgaccgtccttcgtcagcccaaggctgccccctcggtcactctgttcccaccctcctcacgtagcgtgctgagcgggctggcaaggcgcatagnn

SEQ ID NO: 3036 - DNA, 175 bp, Homo sapiens
  misc_feature: GYAE6OF01B5RKY.30.86.H09.1.454.CMB.1.raw
  modified_base (173)..(175): a, c, t, g, unknown or other
  misc_feature (173)..(175): n is a, c, g, or t
tcagcacgctacgtcacgaccggtgctcgatttagtgctatagacttgggtttgggtgtcttcggcggagggaccaagctgaccgtccttcgtcagcccaaggctgccccctcggtcactctgttcccgccctcctcacgtagcgtgctgagcgggctggcaaggcgcatagnnn

SEQ ID NO: 3037 - DNA, 192 bp, Homo sapiens
  misc_feature: GYAE6OF01BTMIR.30.86.H09.1.454.CMB.1.raw
  modified_base (173)..(192): a, c, t, g, unknown or other
  misc_feature (173)..(192): n is a, c, g, or t
tcagcacgctacgtcacgaccggtgctcgatttagtgctatagacttgggtttgggtgtcttcggcggagggaccaagctgaccgtccttcgtcagcccaaggctgccccctcggtcactctgttcccaccctcctcacgtagcgtgctgagcgggctggcaaggcgcatagnnnnnnnnnnnnnnnnnnnn

SEQ ID NO: 3038 - DNA, 173 bp, Homo sapiens; identical to SEQ ID NO: 3012
  misc_feature: GYAE6OF01B1JN4.30.86.H09.1.454.CMB.1.raw
  modified_base (172)..(173): a, c, t, g, unknown or other
  misc_feature (172)..(173): n is a, c, g, or t

SEQ ID NO: 3039 - DNA, 174 bp, Homo sapiens; identical to SEQ ID NO: 3035
  misc_feature: GYAE6OF01EXEQ3.30.86.H09.1.454.CMB.1.raw
  modified_base (173)..(174): a, c, t, g, unknown or other
  misc_feature (173)..(174): n is a, c, g, or t

SEQ ID NO: 3040 - DNA, 219 bp, Homo sapiens
  misc_feature: GYAE6OF01BD4W3.30.86.H09.1.454.CMB.1.raw
  modified_base (184)..(219): a, c, t, g, unknown or other
  misc_feature (184)..(219): n is a, c, g, or t
tcagcacgctacgtcacgaccggtgctcgatttagtgctatagacgttaggggtttgggtgtcttccggcggagggaccaagctgaccgtccttcggtcagcccaagggcctgccccctcggtcactcgtgttccccaccctcctcacgtagcgtgcctgagccgggctggcaaggcgcatagnnnnnnnnnnnnnnnnnnnnnnnnnnnnnnnnnnnn

SEQ ID NO: 3041 - DNA, 193 bp, Homo sapiens
  misc_feature: GYAE6OF01CP767.30.86.H09.1.454.CMB.1.raw
  modified_base (175)..(193): a, c, t, g, unknown or other
  misc_feature (175)..(193): n is a, c, g, or t
tcagcacgctacgtcacgaccggtgctcgatttagtgctatagactttggggtttgggtgtcttcggcggagggaccaagctgaccgtccttcgtcagcccaaggctcgccccctcggtcactctgttcccaccctctcacgtagcgtgctgagcgggctggcaaggcgcatagnnnnnnnnnnnnnnnnnnn

SEQ ID NO: 3042 - DNA, 386 bp, Homo sapiens
  misc_feature: GYAE6OF01EE5PU.30.86.H09.1.454.CMB.1.raw
  modified_base (377)..(377): a, c, t, g, unknown or other
  misc_feature (377)..(377): n is a, c, g, or t
  modified_base (382)..(386): a, c, t, g, unknown or other
  misc_feature (382)..(386): n is a, c, g, or t
tcagcacgctacgtcacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgatttttccggatttgcctaggaaaaccagcctacacgcttaaaccgggacaaccgtcgcccggccaacatagccttctccgtcccccttgcagtaacaccaagtacagaatattaacctgttccatcgactacgcctttcggcctcgccttaggggtcactcaccctgccccgtattaacgttggacaggtacccttggtcttcggcagcggctggcaaggcncatgnnnnn

SEQ ID NO: 3043 - DNA, 650 bp, Homo sapiens
  misc_feature: GYAE6OF01C18AC.30.86.H09.1.454.CMB.1.raw
  modified_base (154)..(154): a, c, t, g, unknown or other
  misc_feature (154)..(154): n is a, c, g, or t
  modified_base (591)..(591): a, c, t, g, unknown or other
  misc_feature (591)..(591): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (599)..(604): a, c, t, g, unknown or other
  misc_feature (599)..(604): n is a, c, g, or t
  modified_base (606)..(606): a, c, t, g, unknown or other
  misc_feature (606)..(606): n is a, c, g, or t
  modified_base (609)..(650): a, c, t, g, unknown or other
  misc_feature (609)..(650): n is a, c, g, or t
tcagcacgctacgtcacgaccggtgctcgatttagtgctatagactttggggttttgggggtacgattttgatgttacctgatgcttagaggtctttttccgtggaagcagggctattttgttgcttcagccaccgtagtcgcctcgtcatccnccgcctcagtccttggttacttttccggtattttcgacccgtaaacggaaaaccacgaccctaacgaccggtaacccgtaaaacccgggaccctaacccggtcccggcccccgaccaaactacttaccgtccctttcccctcccccgttccccccttgactaacgtaaaccaccgaagtacaaggtaactttacgttaacccgttcgtttaccccagtaccaaccgttcccggttacccgttttccggccccttccgggttacccggttaaggggggtcccctacccctccccgttacccccgtccggtacccccgtttaaacggtttaacccggttacgggaacccgtaaccggttaccccggtttacgggttcccgttccgggaccgggtacggcggggtacgtacggaccggtaagggccaaccgtagttacgntangnctnnnnnngnacnnnnnnnnnnnnnnnnnnnnnnnnnnnnnnnnnnnnnnnnnn

SEQ ID NO: 3044 - DNA, 518 bp, Homo sapiens
  misc_feature: GYAE6OF01BEDHR.30.86.H09.1.454.CMB.1.raw
  modified_base (182)..(182): a, c, t, g, unknown or other
  misc_feature (182)..(182): n is a, c, g, or t
  modified_base (418)..(418): a, c, t, g, unknown or other
  misc_feature (418)..(418): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
  modified_base (468)..(469): a, c, t, g, unknown or other
  misc_feature (468)..(469): n is a, c, g, or t
  modified_base (471)..(471): a, c, t, g, unknown or other
  misc_feature (471)..(471): n is a, c, g, or t
  modified_base (473)..(518): a, c, t, g, unknown or other
  misc_feature (473)..(518): n is a, c, g, or t
tcagcacgctacgtcacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgtattttccggatttgcctaggaaaaccngcctacacgtacttaaaccgggacaaccgtccgccccggaccaaacatacgtcccttccgtccccgttccccccttcgcctaagtaaaccaaccgaaagtaccaaggtaaattacttaaccttgttcccatccgactaccgtcctttcggcctcgccgttaggggtccgacctccaccccgtcgccccgtaagttaaccgtggaaccgacggtaacccgtttggtccgttccgggngacggccgggtctcgggacgaacggccgacaagtacgnagctgnacagcnngncnnnnnnnnnnnnnnnnnnnnnnnnnnnnnnnnnnnnnnnnnnnnnn

SEQ ID NO: 3045 - DNA, 188 bp, Homo sapiens
  misc_feature: GYAE6OF01ESZ4T.30.86.H09.1.454.CMB.1.raw
  modified_base (174)..(188): a, c, t, g, unknown or other
  misc_feature (174)..(188): n is a, c, g, or t
tcagcacgctacgtcacgaccggtgctcgatttagtgctatagacttgggtttgggtgtcttcggcggagggaccaagctgaccgtccttcgtcagcccaaggctgccccctcggtcactctgttccccaccctcctcacgtagcgtgctgagcgggctggcaaggcgcatagnnnnnnnnnnnnnnn

SEQ ID NO: 3046 - DNA, 165 bp, Homo sapiens
  misc_feature: GYAE6OF02I7EA7.30.86.H09.1.454.CMB.1.raw
  modified_base (164)..(165): a, c, t, g, unknown or other
  misc_feature (164)..(165): n is a, c, g, or t
tcagcacgctacgtcacgaccggtgctcgattagtgctatagacttggttggtgtcttcggcggaggaccaagctgaccgtccttcgtcagccaaggctgccctcggtcactctgttcccgcctcctcacgtagcgtgctgagcgggctggcaaggcgcatagnn

SEQ ID NO: 3047 - DNA, 173 bp, Homo sapiens; identical to SEQ ID NO: 3012
  misc_feature: GYAE6OF02I1K6C.30.86.H09.1.454.CMB.1.raw
  modified_base (172)..(173): a, c, t, g, unknown or other
  misc_feature (172)..(173): n is a, c, g, or t

SEQ ID NO: 3048 - DNA, 171 bp, Homo sapiens
  misc_feature: GYAE6OF02I26SC.30.86.H09.1.454.CMB.1.raw
  modified_base (171)..(171): a, c, t, g, unknown or other
  misc_feature (171)..(171): n is a, c, g, or t
tcagcacgctacgtcacgaccggtgctcgatttagtgctatagacttgggttgggtgtcttcggcggagggaccaagctgaccgtccttcgtcagcccaaggctgcccctcggtcactctgttcccaccctcctcacgtagcgtgctgagcgggctggcaaggcgcatagn

SEQ ID NO: 3049 - DNA, 177 bp, Homo sapiens
  misc_feature: GYAE6OF02H99K6.30.86.H09.1.454.CMB.1.raw
  modified_base (172)..(177): a, c, t, g, unknown or other
  misc_feature (172)..(177): n is a, c, g, or t
tcagcacgctacgtcacgaccggtgctcgatttagtgctatagacttgggtttgggtgtcttcggcggagggaccaagctgaccgtccttcgtcagcccaaggctgcccctcggtcactctgttcccgccctcctcacgtagcgtgctgagcgggctggcaaggcgcatagnnnnnn

SEQ ID NO: 3050 - DNA, 171 bp, Homo sapiens
  misc_feature: GYAE6OF02F7G8P.30.86.H09.1.454.CMB.1.raw
  modified_base (171)..(171): a, c, t, g, unknown or other
  misc_feature (171)..(171): n is a, c, g, or t
tcagcacgctacgtcacgaccggtgctcgatttagtgctatagacttgggtttggtgtcttcggcggagggaccaagctgaccgtccttcgtcagcccaaggctgcccctcggtcactctgttcccgccctcctcacgtagcgtgctgagcgggctggcaaggcgcatagn

SEQ ID NO: 3051 - DNA, 176 bp, Homo sapiens; identical to SEQ ID NO: 3010
  misc_feature: GYAE6OF02G8VJC.30.86.H09.1.454.CMB.1.raw
  modified_base (172)..(176): a, c, t, g, unknown or other
  misc_feature (172)..(176): n is a, c, g, or t

SEQ ID NO: 3052 - DNA, 187 bp, Homo sapiens
  misc_feature: GYAE6OF02F30ZV.30.86.H09.1.454.CMB.1.raw
  modified_base (172)..(187): a, c, t, g, unknown or other
  misc_feature (172)..(187): n is a, c, g, or t
tcagcacgctacgtcacgaccggtgctcgatttagtgctatagacttgggtttgggtgtcttcggcggagggaccaagctgaccgtccttcgtcagcccaaggctgcccctcggtcactctgttcccaccctcctcacgtagcgtgctgagcgggctggcaaggcgcatagnnnnnnnnnnnnnnnn

SEQ ID NO: 3053 - DNA, 172 bp, Homo sapiens; identical to SEQ ID NO: 3011
  misc_feature: GYAE6OF02IMA9D.30.86.H09.1.454.CMB.1.raw
  modified_base (172)..(172): a, c, t, g, unknown or other
  misc_feature (172)..(172): n is a, c, g, or t

SEQ ID NO: 3054 - DNA, 173 bp, Homo sapiens; identical to SEQ ID NO: 3012
  misc_feature: GYAE6OF02JENXX.30.86.H09.1.454.CMB.1.raw
  modified_base (172)..(173): a, c, t, g, unknown or other
  misc_feature (172)..(173): n is a, c, g, or t

SEQ ID NO: 3055 - DNA, 174 bp, Homo sapiens; identical to SEQ ID NO: 3023
  misc_feature: GYAE6OF02GTVGF.30.86.H09.1.454.CMB.1.raw
  modified_base (172)..(174): a, c, t, g, unknown or other
  misc_feature (172)..(174): n is a, c, g, or t

SEQ ID NO: 3056 - DNA, 171 bp, Homo sapiens
  misc_feature: GYAE6OF02FIEPF.30.86.H09.1.454.CMB.1.raw
  modified_base (171)..(171): a, c, t, g, unknown or other
  misc_feature (171)..(171): n is a, c, g, or t
tcagcacgctacgtcacgaccggtgctcgatttagtgctatagacttgggtttgggtgtcttcggcggaggaccaagctgaccgtccttcgtcagcccaaggctgcccctcggtcactctgttcccaccctcctcacgtagcgtgctgagcgggctggcaaggcgcatagn

SEQ ID NO: 3057 - DNA, 177 bp, Homo sapiens
  misc_feature: GYAE6OF02H9NI1.30.86.H09.1.454.CMB.1.raw
  modified_base (171)..(177): a, c, t, g, unknown or other
  misc_feature (171)..(177): n is a, c, g, or t
tcagcacgctacgtcacgaccggtgctcgatttagtgctatagacttgggtttgggtgtcttcggcggagggaccaagctgaccgtcttcgtcagcccaaggctgccccctcggtcactctgttcccaccctcctcacgtagctgctgagcgggctggcaaggcgcatagnnnnnnn

SEQ ID NO: 3058 - DNA, 172 bp, Homo sapiens; identical to SEQ ID NO: 3011
  misc_feature: GYAE6OF02FINWB.30.86.H09.1.454.CMB.1.raw
  modified_base (172)..(172): a, c, t, g, unknown or other
  misc_feature (172)..(172): n is a, c, g, or t

SEQ ID NO: 3059 - DNA, 204 bp, Homo sapiens
  misc_feature: GYAE6OF02F1BSW.30.86.H09.1.454.CMB.1.raw
  modified_base (177)..(204): a, c, t, g, unknown or other
  misc_feature (177)..(204): n is a, c, g, or t
tcagcacgctacgtcacgaccggtgctcgatttagtgctatagacttgggtttgggtgtcgttcggcggagggaccaagctgaccgtccttcggtcagcccaaggctgccccctcggtcacctctgttcccacccctcctcacgtagcgtgctgagcgggctggcaaggcgcatagnnnnnnnnnnnnnnnnnnnnnnnnnnnn

SEQ ID NO: 3060 - DNA, 172 bp, Homo sapiens; identical to SEQ ID NO: 3009
  misc_feature: GYAE6OF02FZYOO.30.86.H09.1.454.CMB.1.raw
  modified_base (172)..(172): a, c, t, g, unknown or other
  misc_feature (172)..(172): n is a, c, g, or t

SEQ ID NO: 3061 - DNA, 178 bp, Homo sapiens
  misc_feature: GYAE6OF02F7NBF.30.86.H09.1.454.CMB.1.raw
  modified_base (174)..(178): a, c, t, g, unknown or other
  misc_feature (174)..(178): n is a, c, g, or t
tcagcacgctacgtcacgaccggtgctcgatttagtgctatagacttgggtttgggtggtcttcggcggagggaccaagctgaccgtccttcgtcagcccaaggctgccccctcggtcactctgttcccgccctcctcacgtagcgtgctgagcgggctggcaaggcgcatagnnnnn

SEQ ID NO: 3062 - DNA, 222 bp, Homo sapiens
  misc_feature: GYAE6OF02IEIMY.30.86.H09.1.454.CMB.1.raw
  modified_base (178)..(222): a, c, t, g, unknown or other
  misc_feature (178)..(222): n is a, c, g, or t
tcagcacgctacgtcacgaccggtgctcgatttagtgctatagacttgggtttgggtgtcgttcggcggagggaccaagctgaccgtccttcgtcagcccaagggctgccccctcggtcactctgttcccgccctcctcacggtagcgttgctgagccgggctggcaaggcgcatagnnnnnnnnnnnnnnnnnnnnnnnnnnnnnnnnnnnnnnnnnnnnn

SEQ ID NO: 3063 - DNA, 172 bp, Homo sapiens; identical to SEQ ID NO: 3011
  misc_feature: GYAE6OF02F9MWC.30.86.H09.1.454.CMB.1.raw
  modified_base (172)..(172): a, c, t, g, unknown or other
  misc_feature (172)..(172): n is a, c, g, or t

SEQ ID NO: 3064 - DNA, 194 bp, Homo sapiens
  misc_feature: GYAE6OF02GSZCJ.30.86.H09.1.454.CMB.1.raw
  modified_base (173)..(194): a, c, t, g, unknown or other
  misc_feature (173)..(194): n is a, c, g, or t
tcagcacgctacgtcacgaccggtgctcgatttagtgctatagacttgggtttgggtgtcttcggccggagggaccaagctgaccgtccttcgtcagcccaaggctgcccctcggtcactctgttcccaccctcctcacgtagcgtgctgagcgggctggcaaggcgcatagnnnnnnnnnnnnnnnnnnnnnn

SEQ ID NO: 3065 - DNA, 172 bp, Homo sapiens; identical to SEQ ID NO: 3011
  misc_feature: GYAE6OF02I9EYM.30.86.H09.1.454.CMB.1.raw
  modified_base (172)..(172): a, c, t, g, unknown or other
  misc_feature (172)..(172): n is a, c, g, or t

SEQ ID NO: 3066 - DNA, 173 bp, Homo sapiens; identical to SEQ ID NO: 3012
  misc_feature: GYAE6OF02HOPWH.30.86.H09.1.454.CMB.1.raw
  modified_base (172)..(173): a, c, t, g, unknown or other
  misc_feature (172)..(173): n is a, c, g, or t

SEQ ID NO: 3067 - DNA, 174 bp, Homo sapiens; identical to SEQ ID NO: 3023
  misc_feature: GYAE6OF02FNVVD.30.86.H09.1.454.CMB.1.raw
  modified_base (172)..(174): a, c, t, g, unknown or other
  misc_feature (172)..(174): n is a, c, g, or t

SEQ ID NO: 3068 - DNA, 173 bp, Homo sapiens; identical to SEQ ID NO: 3012
  misc_feature: GYAE6OF02I3WE2.30.86.H09.1.454.CMB.1.raw
  modified_base (172)..(173): a, c, t, g, unknown or other
  misc_feature (172)..(173): n is a, c, g, or t

SEQ ID NO: 3069 - DNA, 175 bp, Homo sapiens
  misc_feature: GYAE6OF02H8L8I.30.86.H09.1.454.CMB.1.raw
  modified_base (172)..(175): a, c, t, g, unknown or other
  misc_feature (172)..(175): n is a, c, g, or t
tcagcacgctacgtcacgaccggtgctcgatttagtgctatagacttgggtttgggtgtcttcggcggagggaccaagctgaccgtccttcgtcagcccaaggctgcccctcggtcactctgttcccaccctcctcacgtagcgtgctgagcgggctggcaaggcgcatagnnnn

SEQ ID NO: 3070 - DNA, 208 bp, Homo sapiens
  misc_feature: GYAE6OF02H1X35.30.86.H09.1.454.CMB.1.raw
  modified_base (175)..(208): a, c, t, g, unknown or other
  misc_feature (175)..(208): n is a, c, g, or t
tcagcacgctacgtcacgaccggtgctcgatttagtgctatagacttggggtttgggtgtcttcggcggagggaccaagctgaccgtccttacgtcacgcccaaggctgccccctcggtcactctgttcccgcctcctcacgtagcgtgctgagcgggctggcaaggcgcatagnnnnnnnnnnnnnnnnnnnnnnnnnnnnnnnnnn

SEQ ID NO: 3071 - DNA, 178 bp, Homo sapiens
  misc_feature: GYAE6OF02INH2B.30.86.H09.1.454.CMB.1.raw
  modified_base (142)..(142): a, c, t, g, unknown or other
  misc_feature (142)..(142): n is a, c, g, or t
  modified_base (172)..(178): a, c, t, g, unknown or other
  misc_feature (172)..(178): n is a, c, g, or t
tcagcacgctacgtcacgaccggtgctcgatttagtgctatagacttgggtttgggtggtcttcggcggagggaccaagctgaccgtccttcgtcagcccaaggctgcccctcggtcactctgttcccacctcctcacgtancgtgctgagcgggctggcaaggcgcatagnnnnnnn

SEQ ID NO: 3072 - DNA, 203 bp, Homo sapiens
  misc_feature: GYAE6OF02G9OE9.30.86.H09.1.454.CMB.1.raw
  modified_base (173)..(203): a, c, t, g, unknown or other
  misc_feature (173)..(203): n is a, c, g, or t
tcagcacgctacgtcacgaccggtgctcgatttagtgctatagacttgggtttgggtgtcttcggcggagggaccaagctgaccgtccttcgtcagcccaaggctgccccctcggtcactctgttcccaccctcctcacgtagcgtgctgagcgggctggcaaggcgcatagnnnnnnnnnnnnnnnnnnnnnnnnnnnnnnn

SEQ ID NO: 3073 - DNA, 175 bp, Homo sapiens; identical to SEQ ID NO: 3036
  misc_feature: GYAE6OF02JHWV8.30.86.H09.1.454.CMB.1.raw
  modified_base (173)..(175): a, c, t, g, unknown or other
  misc_feature (173)..(175): n is a, c, g, or t

SEQ ID NO: 3074 - DNA, 175 bp, Homo sapiens; identical to SEQ ID NO: 3030
  misc_feature: GYAE6OF02H2J93.30.86.H09.1.454.CMB.1.raw
  modified_base (173)..(175): a, c, t, g, unknown or other
  misc_feature (173)..(175): n is a, c, g, or t

SEQ ID NO: 3075 - DNA, 174 bp, Homo sapiens; identical to SEQ ID NO: 3035
  misc_feature: GYAE6OF02GO0NF.30.86.H09.1.454.CMB.1.raw
  modified_base (173)..(174): a, c, t, g, unknown or other
  misc_feature (173)..(174): n is a, c, g, or t

SEQ ID NO: 3076 - DNA, 182 bp, Homo sapiens
  misc_feature: GYAE6OF02G99GU.30.86.H09.1.454.CMB.1.raw
  modified_base (172)..(182): a, c, t, g, unknown or other
  misc_feature (172)..(182): n is a, c, g, or t
tcagcacgctacgtcacgaccggtgctcgatttagtgctatagacttgggtttgggtgtcttcggcggagggaccaagctgaccgtccttcgtcagcccaaggctgcccctcggtcactctgttcccgccctcctcacgtagcgtgctgagcgggctggcaaggcgcatagnnnnnnnnnnn

SEQ ID NO: 3077 - DNA, 175 bp, Homo sapiens; identical to SEQ ID NO: 3028
  misc_feature: GYAE6OF02HEANG.30.86.H09.1.454.CMB.1.raw
  modified_base (172)..(175): a, c, t, g, unknown or other
  misc_feature (172)..(175): n is a, c, g, or t

SEQ ID NO: 3078 - DNA, 175 bp, Homo sapiens; identical to SEQ ID NO: 3030
  misc_feature: GYAE6OF02JGLXD.30.86.H09.1.454.CMB.1.raw
  modified_base (173)..(175): a, c, t, g, unknown or other
  misc_feature (173)..(175): n is a, c, g, or t

SEQ ID NO: 3079 - DNA, 196 bp, Homo sapiens
  misc_feature: GYAE6OF02INPSF.30.86.H09.1.454.CMB.1.raw
  modified_base (176)..(196): a, c, t, g, unknown or other
  misc_feature (176)..(196): n is a, c, g, or t
tcagcacgctacgtcacgaccggtgctcgatttagtgctatagacttggggtttgggtgtcttcggcggagggaccaagctgaccgtccttcgtcagcccaagggctgcccctcggtcactctgttccccaccctcctcacgtagcgtgctgagcgggctgggcaaggcgcatagnnnnnnnnnnnnnnnnnnnnn

SEQ ID NO: 3080 - DNA, 175 bp, Homo sapiens; identical to SEQ ID NO: 3030
  misc_feature: GYAE6OF02FLB2F.30.86.H09.1.454.CMB.1.raw
  modified_base (173)..(175): a, c, t, g, unknown or other
  misc_feature (173)..(175): n is a, c, g, or t

SEQ ID NO: 3081 - DNA, 173 bp, Homo sapiens; identical to SEQ ID NO: 3029
  misc_feature: GYAE6OF02FN6N9.30.86.H09.1.454.CMB.1.raw
  modified_base (173)..(173): a, c, t, g, unknown or other
  misc_feature (173)..(173): n is a, c, g, or t

SEQ ID NO: 3082 - DNA, 188 bp, Homo sapiens
  misc_feature: GYAE6OF02FORID.30.86.H09.1.454.CMB.1.raw
  modified_base (174)..(188): a, c, t, g, unknown or other
  misc_feature (174)..(188): n is a, c, g, or t
tcagcacgctacgtcacgaccggtgctcgatttagtgctatagacttgggtttgggtggtcttcggcggagggaccaagctgaccgtccttcgtcagcccaaggctgccccctcggtcactctgttcccaccctcctcacgtagcgtgctgagcgggctggcaaggcgcatagnnnnnnnnnnnnnnn

SEQ ID NO: 3083 - DNA, 395 bp, Homo sapiens
  misc_feature: GYAE6OF02G1RDX.30.86.H09.1.454.CMB.1.raw
  modified_base (383)..(383): a, c, t, g, unknown or other
  misc_feature (383)..(383): n is a, c, g, or t
  modified_base (389)..(395): a, c, t, g, unknown or other
  misc_feature (389)..(395): n is a, c, g, or t
tcagcacgctacgtcacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttcgcagtaacaccaagtacaggaatattaacctgtttcccatcgactacgcctttcggcctcgccttagggtcgactcacccctgccccgattaacgttggacaggaacccttggtcttccggcgagcgggctggcaaggcncatagnnnnnnn

SEQ ID NO: 3084 - DNA, 175 bp, Homo sapiens; identical to SEQ ID NO: 3030
  misc_feature: GYAE6OF02H4LDI.30.86.H09.1.454.CMB.1.raw
  modified_base (173)..(175): a, c, t, g, unknown or other
  misc_feature (173)..(175): n is a, c, g, or t

SEQ ID NO: 3085 - DNA, 492 bp, Homo sapiens
  misc_feature: GYAE6OF01E4FN3.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagttattactgtcagcagtattatagtagtcctcagacttttggccggggtacaagcctggagatcaaacgaactgtggctgcaccatctgcttcatcc

SEQ ID NO: 3086 - DNA, 500 bp, Homo sapiens
  misc_feature: GYAE6OF01BB8UK.39.31.C09.1.454.CMB.1.raw
  modified_base (494)..(494): a, c, t, g, unknown or other
  misc_feature (494)..(494): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtgcagtttattactgtcagcagtattatagtagtcctcagtacttttggccggggtaccaagctggagatacgaaacgactgtggctgcacctatctgtcttcnttcccg

SEQ ID NO: 3087 - DNA, 508 bp, Homo sapiens
  misc_feature: GYAE6OF01D6BNK.39.31.C09.1.454.CMB.1.raw
  modified_base (291)..(291): a, c, t, g, unknown or other
  misc_feature (291)..(291): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacngggcatctacccgggagtccggggtccctgaccgattcagcggcaggcgggtctgagacagatttcactctcaccatcagcagcctgcaggctagaagatgtggctagtttattacgtgtcagctaagttattatagtagtcctcagtacttttgggccggggtaccaggctggagatacaaacgtactgaggctgcacctntctntcttcnttccc

SEQ ID NO: 3088 - DNA, 523 bp, Homo sapiens
  misc_feature: GYAE6OF01C65CM.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacagtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtgctagtttatactgtcagctaagtattatagtagtcctacagtacgtttgggaccggggtaccaaggcgtaggacgagtacgaaacgaactggtacggctagccacctactacttggttccttgacttcccg

SEQ ID NO: 3089 - DNA, 496 bp, Homo sapiens
  misc_feature: GYAE6OF01A9J40.39.31.C09.1.454.CMB.1.raw
  modified_base (493)..(493): a, c, t, g, unknown or other
  misc_feature (493)..(493): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtacttttgggccggggaccagctggagatcaaacgactgtggctgcaccatctgtcttcntcc

SEQ ID NO: 3090 - DNA, 498 bp, Homo sapiens
  misc_feature: GYAE6OF01ENE9L.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattactgtcagcagtattatagtagtcctcagtacttttggccggggaccaagctggagatacaaacgactgtggctgcaccatctgtcttcattccg

SEQ ID NO: 3091 - DNA, 501 bp, Homo sapiens
  misc_feature: GYAE6OF01BTO19.39.31.C09.1.454.CMB.1.raw
  modified_base (428)..(428): a, c, t, g, unknown or other
  misc_feature (428)..(428): n is a, c, g, or t
  modified_base (475)..(475): a, c, t, g, unknown or other
  misc_feature (475)..(475): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcagcggtctgagacagatttcactctcaccatcagcagcctgcagctgaagatgtggctagtttattactgtcagctagtattatagtagtcctnagtacgtttggaccggggtaccagcgtaggagatacgaaacgactgnggctgcaccatctntcttcnttcccg

SEQ ID NO: 3092 - DNA, 511 bp, Homo sapiens
  misc_feature: GYAE6OF01CZEF3.39.31.C09.1.454.CMB.1.raw
  modified_base (504)..(504): a, c, t, g, unknown or other
  misc_feature (504)..(504): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccgggtccctgaccgattcagcgcagcgggtctgagacagtatttcactctcacatcagcagcctgcaggctgaagatgtggctagtttattactgtcagcagttattatagtagtcctctagtacgttttgggccggggtaccaggcgtaggagagtacaaacgtactgtggctgccacctatctgttccttcncttcccg

SEQ ID NO: 3093 - DNA, 494 bp, Homo sapiens
  misc_feature: GYAE6OF01BEG8W.39.31.C09.1.454.CMB.1.raw
  modified_base (430)..(430): a, c, t, g, unknown or other
  misc_feature (430)..(430): n is a, c, g, or t
  modified_base (489)..(490): a, c, t, g, unknown or other
  misc_feature (489)..(490): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattactgtcagcagtattatagtagtcctnagtactttggccggggacagctggagatacaaacgactgtggctgcaccatctgtcttnntccg

SEQ ID NO: 3094 - DNA, 498 bp, Homo sapiens
  misc_feature: GYAE6OF01BV23U.39.31.C09.1.454.CMB.1.raw
  modified_base (291)..(291): a, c, t, g, unknown or other
  misc_feature (291)..(291): n is a, c, g, or t
  modified_base (492)..(493): a, c, t, g, unknown or other
  misc_feature (492)..(493): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtccctgaccgattcagcggcagcgggtctgagacagatttcactctcaccatcagcagcctgcaggctgaagatgtggcagtttattactgtcagcagtattatagtagtcctcagtactttggccggggaccagcgtggagatacaaacgactgtaggctgcacctatctgtcttnntcccg

SEQ ID NO: 3095 - DNA, 496 bp, Homo sapiens
  misc_feature: GYAE6OF01CV0CP.39.31.C09.1.454.CMB.1.raw
  modified_base (427)..(427): a, c, t, g, unknown or other
  misc_feature (427)..(427): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
tcagtcgcactagtcacgaccggtgctcgatttagacgtctcatcaaggaaggaaggggcagcaagatggtgttgcggacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtgcagtttatactgtcagcagtatatagtagtcctnagtactttggccggggtacaagctggagatcaacgaacgtgtgctgcacatctntcttcntcttccccg

SEQ ID NO: 3096 - DNA, 497 bp, Homo sapiens
  misc_feature: GYAE6OF01A0UQ2.39.31.C09.1.454.CMB.1.raw
  modified_base (493)..(493): a, c, t, g, unknown or other
  misc_feature (493)..(493): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtactttggccgggtacagctggagagtacaaacgtactgtggctgcaccatctgtcttcntccc

SEQ ID NO: 3097 - DNA, 527 bp, Homo sapiens
  misc_feature: GYAE6OF01DQV1R.39.31.C09.1.454.CMB.1.raw
  modified_base (437)..(437): a, c, t, g, unknown or other
  misc_feature (437)..(437): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatccgtacccgggagtccggggtccctgaccgattcagcggcaggcgggtctgagacagtatttcactctcaccatcagcagcctgcaggctagaagatgtggctagtttattactgtcagctagtattatagtagtcctntagtacgttttgggaccggggtaccaagcgtaggagacgtacaaaacgtacgtaggtggtctcgacacctatactgttcttcgcttcccg

SEQ ID NO: 3098 - DNA, 497 bp, Homo sapiens
  misc_feature: GYAE6OF01DEZ5O.39.31.C09.1.454.CMB.1.raw
  modified_base (485)..(485): a, c, t, g, unknown or other
  misc_feature (485)..(485): n is a, c, g, or t
  modified_base (493)..(494): a, c, t, g, unknown or other
  misc_feature (493)..(494): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtccctgaccgattcagcggcagcgggtctgagacagatttcactctcaccatcagcagcctgcaggctgaagatgtggcagtttattactgtcagcagtattatagtagtcctactagtacttttggccggggtaccagcgtggagatacaaacgaactgtggctgcacntctgtctnntcc

SEQ ID NO: 3099 - DNA, 518 bp, Homo sapiens
  misc_feature: GYAE6OF01BJYKV.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtcctgaccgattcagcggcagcggtccgagacagatttcactctcaccatcagcagcctgcaggctgaagatgtggctagtttattactgtcagctagtattatagtagtcctctacgtacgtttcgggaccggggtacaagcgtggagactacgaaacgtacgtggtggctcgcactacgtctagtccttctatcttaccg

SEQ ID NO: 3100 - DNA, 514 bp, Homo sapiens
  misc_feature: GYAE6OF01DVL81.39.31.C09.1.454.CMB.1.raw
  modified_base (436)..(436): a, c, t, g, unknown or other
  misc_feature (436)..(436): n is a, c, g, or t
  modified_base (507)..(507): a, c, t, g, unknown or other
  misc_feature (507)..(507): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaaccaggacagcctcctaagttgctcatttactgggcatctacccgggagtccggggtccctgaccgattcagcggcaggcggtctgagacagatttcactctcaccatcagcagcctgcaggctagaagatgtggctagtttattacgtgtcagctagtattatagtagtcctnagtacgtttcgggccggggacagcgtggagatacaaacgtacgtagtggctgacaccgtatctagtcttcncttcccg

SEQ ID NO: 3101 - DNA, 508 bp, Homo sapiens
  misc_feature: GYAE6OF01DERXB.39.31.C09.1.454.CMB.1.raw
  modified_base (502)..(502): a, c, t, g, unknown or other
  misc_feature (502)..(502): n is a, c, g, or t
tcagtcgcactagtcacgaccggtgctcgatttagacgtctcatcaaggaaggaaggggcagcaagatggtgttgcagacccaggtcttcattctctgttgctctggatctctggtgcctacggggacatcgtgatgacccagtctccagactccctggctgtgtctctgggcgagagggccaccatcaactgcaagtccagccagagtgttttacacaggtccaacaaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtatcctcagtacgttttgggccgggaccgaagcgtaggagatacaaacggtaactaggtggctgcaccatctgtcttcnttcccg

SEQ ID NO: 3102 - DNA, 499 bp, Homo sapiens
  misc_feature: GYAE6OF01B8J3C.39.31.C09.1.454.CMB.1.raw
  modified_base (494)..(494): a, c, t, g, unknown or other
  misc_feature (494)..(494): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcaagtattatagtagtcctcagtacgtttggccggggacaggctggagatacaaacgtactgtggctgcactatctgtcttntatcc

SEQ ID NO: 3103 - DNA, 593 bp, Homo sapiens
  misc_feature: GYAE6OF01CQDKY.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctctaagttgctcatttacnggcatctacccgggagtccggggtcctgaccgattcagcggcagcggtctgagacagatttcactctcaccatcgagcagcctgcgagtctagaaagtgttggtgacttagttttaattacgtgtacgagtcgtaagttaatttaagtagttacgttcctacgtaacggttaccggttttcggggacccgggggtaaccaggtccgtagggaaacgtacgtaaccgaaaacgtacgttaggttacgggccttacggaccctaacctacgttcttacgtttccttccgttactttacccccg

SEQ ID NO: 3104 - DNA, 559 bp, Homo sapiens
  misc_feature: GYAE6OF01CXAMH.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagaattacttcgcttggtaccagcagaaaccaggacagcctcctaagttgctctatttactggcatcgtacccgggagtccggggtcctgaccgattcagcggcaggcggtctgagacagtatttcactctcaccatcagcagcctgcaggctagaagagtgtggctagtttattacgtgtcagtctagttaattagtagttacgtcctacgtacgttacgtttcgggaccggggtaaccaggtcgtaggaagacgtaaccgaaaacgtacgttggtacggtctacggaccaaccctacttcgttagttccttcgtacttccccg

SEQ ID NO: 3105 - DNA, 512 bp, Homo sapiens
  misc_feature: GYAE6OF01DU3O2.39.31.C09.1.454.CMB.1.raw
  modified_base (505)..(505): a, c, t, g, unknown or other
  misc_feature (505)..(505): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatccgtacccgggagtcccggggtccctgaccgattcagcggcaggcggtctgagacagatttcactctcaccatcagcagcctgcaggctgaagatgtggctagtttattactgtcagtctagtattatagtagtcctacagtacgtttggccggggtaccagcgtggagactacgaaacgaactgtggctgacacctatctgtcttncttcccg

SEQ ID NO: 3106 - DNA, 517 bp, Homo sapiens
  misc_feature: GYAE6OF01DM1HC.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatccgtacccgggagtccggggtccctgaccgattcagcgcagcggtctgagacagatttcactctcaccatcagcacgcctgcaggctgaagagtgtaggctagtttattactgtcagctagttattatagtagtcctctagtacgttttggcccggggtacaaggccgtaggagatacaaacggtaactgtggctgcacctatctgtcttcacttcccg

SEQ ID NO: 3107 - DNA, 570 bp, Homo sapiens
  misc_feature: GYAE6OF01BV9GY.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctcatttacngggcatcctacccgggagtccggggtccctgaccgattcagcggcaggcgggtctgagacagtatttcactctcaccatcagcagcctgcaggctagaagatgtggctagtttattacttgtacagtacgtagttattattagttagttccttactacggttacgtttttacggggacccggggtaccgaacgtcgtaggtagtaacgtaaccgaaacgtaacgtaggtaggtccgtacgtaccaccgtacttcttagttccttcctcgttaccccg

SEQ ID NO: 3108 - DNA, 511 bp, Homo sapiens
  misc_feature: GYAE6OF01EITLT.39.31.C09.1.454.CMB.1.raw
  modified_base (504)..(504): a, c, t, g, unknown or other
  misc_feature (504)..(504): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattacgtgtcagcagtattatagtagtcctcgagtacgttttgggccggggtacaggtcgtggagatacgaaacgtactgtggctgcacctatctagtcttcncttcccg

SEQ ID NO: 3109 - DNA, 506 bp, Homo sapiens
  misc_feature: GYAE6OF01D973H.39.31.C09.1.454.CMB.1.raw
  modified_base (501)..(501): a, c, t, g, unknown or other
  misc_feature (501)..(501): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcacgcggggtctgagacagatttcactctcaccatcagcagcctgcaggctgaagatgtggcagtttattactgtcagcagtattatagtagtcctcagtacttttgggccggggtaccgaagcgtggagagtacaaacgactgtggctgcacctatctgtcttcgntcccg

SEQ ID NO: 3110 - DNA, 500 bp, Homo sapiens
  misc_feature: GYAE6OF01A6GNM.39.31.C09.1.454.CMB.1.raw
  modified_base (292)..(292): a, c, t, g, unknown or other
  misc_feature (292)..(292): n is a, c, g, or t
  modified_base (497)..(497): a, c, t, g, unknown or other
  misc_feature (497)..(497): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtccctgaccgattcagcgcagcgggtctgagacagatttcactctcaccatcagcagcctgcaggctgaagatgtggctagtttattactgtcagcagtattatagtagtcctctagtacgtttggccggggtaccagcgtggagtatacgaaacgactgtggctgcactatctgtcttcntcc

SEQ ID NO: 3111 - DNA, 541 bp, Homo sapiens
  misc_feature: GYAE6OF01DDGRC.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaacaataagaattacttcgcttggtaccagcagaaaccaggacagcctcctaagttgctcatttacnggcatctacccgggagtccggggtcctgaccgattcagcggcagcggtctgagacagtatttcactctcaccatcagcagcctgcaggctagaagatgtgatagtttatactgtcagtcaagttattatagtagtcctgtagtacgttttgggacccggggtaacaggccgtaggagtacgtaccgaaaacgtacgtggtaggccttaggccctaacctagttccttggttccttcctacgttccccg

SEQ ID NO: 3112 - DNA, 526 bp, Homo sapiens
  misc_feature: GYAE6OF01CTL7O.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacnggcatcctacccggagtccggggtccctgaccgattcagcggcagcggtctgagacagatttcactctcaccatcagcagcctgcaggctagaagatgtgactagtttatactgtcagcagtattatagtagtcctcagtacgtttggccggggtacagtcgtaggaagtagtacgaaacgtaacgtaggtacggctacgaccaccgtacttactaggttcttcagtttccccg

SEQ ID NO: 3113 - DNA, 506 bp, Homo sapiens
  misc_feature: GYAE6OF01ALDMR.39.31.C09.1.454.CMB.1.raw
  modified_base (501)..(501): a, c, t, g, unknown or other
  misc_feature (501)..(501): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagtgctcatttactgggcatcctacccgggagtccggggtccctgaccgattcagcggcagcgggtctgagacagatttcactctcaccatcagcagcctgcaggctgaagatggtgctagtttattactgtcagcagttattatagtagtcctcgtagtacgtttgggccggggacacgctaggagatacaaacgtacgtgtggctgcactatctagtcttcntcccg

SEQ ID NO: 3114 - DNA, 511 bp, Homo sapiens
  misc_feature: GYAE6OF01DAI4F.39.31.C09.1.454.CMB.1.raw
  modified_base (505)..(505): a, c, t, g, unknown or other
  misc_feature (505)..(505): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatccgtacccgggagtcccggggtccctgaccgattcagcggcaggcgggtctgagacagatttcactctcaccatcagcagcctgcagctgaagatgtggctagtttattactgtcagtcagttattatagtacgtcctagagtacgtttgggaccgggtacaaggctaggagatacgaaacgactagtggctgcacctatctgtctcnttcccg

SEQ ID NO: 3115 - DNA, 500 bp, Homo sapiens
  misc_feature: GYAE6OF01BRRV3.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcacatcagcagcctgcagctgaagatgtgcagtttatactgtcagcagtattatagtaagtcctctagtacttttggccgggggaccaaggcctaggagatacgaaacgaactgtggctgcacatctgtcttgatcccg

SEQ ID NO: 3116 - DNA, 547 bp, Homo sapiens
  misc_feature: GYAE6OF01C2BIU.39.31.C09.1.454.CMB.1.raw
  modified_base (350)..(350): a, c, t, g, unknown or other
  misc_feature (350)..(350): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgcctacggggacatcgtgatgacccagtctccagactccctggctgtgtctctgggcgagagggccaccatcaactgcaagtccagccagagtgttttacacaggtccaacaataagaattacttcgcttggtaccagacagaaaccaggacagcctcctaagttgctcatttactgggcatctacccgggagtcccggggtcctgaccgattcagcggcaggcggtctganacagtatttcactctcaccatcagcagcctgcaggctgaagatggtggactagtttattacgtgtcagtctagtattatagttagtcctagtagtacgttttcgggaccgggggtaaccaggcgtagggaagagtaccgaaacggtaactggtacggcttacggacacctacttcttggttccttcgtacttccccg

SEQ ID NO: 3117 - DNA, 502 bp, Homo sapiens
  misc_feature: GYAE6OF01BGQXS.39.31.C09.1.454.CMB.1.raw
  modified_base (486)..(486): a, c, t, g, unknown or other
  misc_feature (486)..(486): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtggctagtttatactgtcagctagtattatagtagtcctacagtacgtttgggccggggaccagcgtggagatacaaacgactgtggctgcacctntctgtcttctgttccc

SEQ ID NO: 3118 - DNA, 521 bp, Homo sapiens
  misc_feature: GYAE6OF01DY3I5.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcaactctcaccatcagcagcctgcaggctgaagatgtggctagtttattactgtcagcagtattatagtagtcctacagtacgttttgggaccggggtaccaagcgtaggagacgtacaaacgaaccgtgtagggtctgtccacctatcctgttcttcagttcccg

SEQ ID NO: 3119 - DNA, 501 bp, Homo sapiens
  misc_feature: GYAE6OF01C3JEU.39.31.C09.1.454.CMB.1.raw
  modified_base (291)..(291): a, c, t, g, unknown or other
  misc_feature (291)..(291): n is a, c, g, or t
  modified_base (496)..(496): a, c, t, g, unknown or other
  misc_feature (496)..(496): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgttttacacaggtccaacaataagaattacttcgcttggtaccagcagaaaccaggacagcctcctaagttgctcatttacnggcatctacccgggagtccggggtccctgaccgatcagcggcagcgggtctgagacagatttcactctcaccatcagcagcctgcaggctgaagatgtggctagtttattactgtcagtcagttattatagtactcctcagtactttgggccggggtacagcgtggagtaatacaaacgactgtaggctgacacatctgtctctnttccg

SEQ ID NO: 3120 - DNA, 561 bp, Homo sapiens
  misc_feature: GYAE6OF01COO33.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcagaaaccaggacagcctcctaagttcgctcatttacgtgggctagtttacccggggagtcccggggtcctgaccgtattcagcggcacggcgggtctgagacagactttcactctacaccatcagcagcctgcagcgtagaagatgtggctaagtttattactgtcagctagttattatagttactcctacagtacgtttgggaccgggtacaaggtcgtaggaagtacgtacgaaacgtaacgtggtacggcttcgacctacctacgttcctacgttaccttcctacgttccccttaccccgg

SEQ ID NO: 3121 - DNA, 551 bp, Homo sapiens
  misc_feature: GYAE6OF01CYHJC.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctcatttactggcatctacccgggagtcccggggtcctgaccgattcagcggcagcggtctgagacagatttcactctcaccatcagcagcctgcaggctgaagatgtggctagtttatactgtcagctagtattatagtagtcctagagtacgttttgggacccggggtaaccaggtccgtaggaacgaattaccgaaaacgtaaccgttggtacggtctacggaccaacccgtattaccttaggttccctttcgtactttaccccg

SEQ ID NO: 3122 - DNA, 508 bp, Homo sapiens
  misc_feature: GYAE6OF01A9405.39.31.C09.1.454.CMB.1.raw
  modified_base (292)..(292): a, c, t, g, unknown or other
  misc_feature (292)..(292): n is a, c, g, or t
  modified_base (502)..(502): a, c, t, g, unknown or other
  misc_feature (502)..(502): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcctacccgggagtccggggtccctgaccgattcagcggcaggcgggtctgagacagatttcactctcaccatcagcagcctgcaggctgaagatgtggctagtttattactgtcagctagtattatagtagtcctcgagtacgtttgggccggggtacagcgtggagatacgaaacgactgtcggctgcacctatctgtcttcnctcccg

SEQ ID NO: 3123 - DNA, 497 bp, Homo sapiens
  misc_feature: GYAE6OF01CDFU4.39.31.C09.1.454.CMB.1.raw
  modified_base (426)..(426): a, c, t, g, unknown or other
  misc_feature (426)..(426): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccggagtccggggtccctgaccgattcagcggcagcggtctgagacagatttcactctcaccatcagcagcctgcaggctgaagatgtggctagtttatactgtcagcagtattatagtatcctnagtacgtttggccggggaacagcgtaggagatacgaaacgactgtggctgcacctatctgtctcattcccg

SEQ ID NO: 3124 - DNA, 508 bp, Homo sapiens
  misc_feature: GYAE6OF01BPVDZ.39.31.C09.1.454.CMB.1.raw
  modified_base (502)..(502): a, c, t, g, unknown or other
  misc_feature (502)..(502): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtcccggggtccctgaccgattcagcggcagcgggtctgagacagatttcactctcaccatcagcagcctgcaggctgaagatgtggctagtttattactgtcagcagtattatagtagtcctcagtacgttttgggccggggaccagcgtggagatacaaacgactagtggctgacacctactctgtcttctnttcccg

SEQ ID NO: 3125 - DNA, 500 bp, Homo sapiens
  misc_feature: GYAE6OF01BIE5T.39.31.C09.1.454.CMB.1.raw
  modified_base (495)..(495): a, c, t, g, unknown or other
  misc_feature (495)..(495): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcagcgggtctgagacagatttcactctcaccatcagcagcctgcaggctgaagagtgtggctagtttattactgtcagcagtattatagtagtctcagtacgttttggccggggacaagctggagatacaaacgtaactgtggctgcaccatctgtcttcntcccg

SEQ ID NO: 3126 - DNA, 505 bp, Homo sapiens
  misc_feature: GYAE6OF01DRA3W.39.31.C09.1.454.CMB.1.raw
  modified_base (217)..(217): a, c, t, g, unknown or other
  misc_feature (217)..(217): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacaactccaagaataagagttctttagcttggtaccagcagaaaccacgacagcctcctaagctgctcgtttactggcctctacccgggaatccggggtccctgaacgtattcagtggcggcggtctgggacagatttcactctcaccatcagcagcctgcgggctgaagatgtggtcggtttattactgtcagcagttattatgttactctctactagtttcggccgagggacctaagctaggagatcgcacgactgtggctgcacntctntctcatctcccgctac

SEQ ID NO: 3127 - DNA, 504 bp, Homo sapiens
  misc_feature: GYAE6OF01DSUWB.39.31.C09.1.454.CMB.1.raw
  modified_base (499)..(499): a, c, t, g, unknown or other
  misc_feature (499)..(499): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtccctgaccgattcagcggcagcgggtctgagacagatttcactctcaccatcagcagcctgcaggctgaagatgtggctagtttattactgtcagcagtattatagtagtcctcagtacgtttggccggggtaccgagcgtggagatacgaaacgaactgtggctgcacctatctgtcttctntcccg

SEQ ID NO: 3128 - DNA, 532 bp, Homo sapiens
  misc_feature: GYAE6OF01CIPYH.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttgcttggtaccagcagaaaccaggacagcctctaagttgctcattactggcatcgtacccggagtccgggtcctgaccgattcagcggcagcggtctgagacagatttcactctacaccatcagcagcctgcagctagaagatgtgactagtttatactgtacagacagtattagtagtacgtcctagtacgtacgttttcgggaccgggtacgaacgtcgtaggagacgtacgaaacgtaacgtaggtacggcgtacgaccacgtataccgtgtcttcgtacgttcccg

SEQ ID NO: 3129 - DNA, 526 bp, Homo sapiens
  misc_feature: GYAE6OF01EUASK.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtccctgaccgattcagcggcagcgggtctgagacagatttcactctcaccatcagcagcctgcaggctgaagatgtggctagtttattactgtcagcagttattatagtagtcctctagtacgttttcgggccggggtaccaaggcgtagggagtagtacaaacggtaactaggtggtctcgcaacctattctagttccttcacttcccg

SEQ ID NO: 3130 - DNA, 513 bp, Homo sapiens
  misc_feature: GYAE6OF01DE10A.39.31.C09.1.454.CMB.1.raw
  modified_base (291)..(291): a, c, t, g, unknown or other
  misc_feature (291)..(291): n is a, c, g, or t
  modified_base (506)..(506): a, c, t, g, unknown or other
  misc_feature (506)..(506): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagtgctcatttacnggcatctacccgggagtccggggtccctgacccgattcagcggcaggcggtctgagacagatttcacgtctacacctatcagcagcctgcaggactgaagatgtggtctagtttactactgtcagtctagtattatacgttactcctcagtacgtttgggccggggtacaggctggagactcgaaacgtactggtgctgacactatctgttctcngttcccg

SEQ ID NO: 3131 - DNA, 529 bp, Homo sapiens
  misc_feature: GYAE6OF01A6GEH.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcctacccgggagtcccggggtccctggaccgattcagcggcagcgggtctgagacagatttcactctcaccatcagcagcctgcaggctagaagatgtgctagtttattactgtcagctagtattatagtagtcctacagtacgtttgggcccggggtacaaggtcgtaggagagtaccaaacggtaactggtacggctgaccaccgtattcgtagttcttcgcttccccg

SEQ ID NO: 3132 - DNA, 505 bp, Homo sapiens
  misc_feature: GYAE6OF01BILZK.39.31.C09.1.454.CMB.1.raw
  modified_base (499)..(499): a, c, t, g, unknown or other
  misc_feature (499)..(499): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtacgtcctcagtacgttttggccggggtaccagcgtaggagatacgaaacgaactgtggctgcacatctgtcttcnttcccg

SEQ ID NO: 3133 - DNA, 497 bp, Homo sapiens
  misc_feature: GYAE6OF01EQWNT.39.31.C09.1.454.CMB.1.raw
  modified_base (493)..(494): a, c, t, g, unknown or other
  misc_feature (493)..(494): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtacgtttggccggggtacaggctggagatacaaacgactgtggctgcaccatctagtctnntcc

SEQ ID NO: 3134 - DNA, 517 bp, Homo sapiens
  misc_feature: GYAE6OF01EN5EH.39.31.C09.1.454.CMB.1.raw
  modified_base (512)..(512): a, c, t, g, unknown or other
  misc_feature (512)..(512): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcagaaaccaggacagcctcctaagttgctcatttactgggcatcctacccgggagtccgggtccctgaccgattcagcggcagcggttctgagacagatttcactctcaccatcagcagcctgcgagctagaagatgtgctagtttattactgtcagcgtagttattatagtatcctagtacgtacgtttcgggaccgggtacagcgtaggagtacgtacgaaacgtacgtgtaggctgacacctatctatcttctntcccg

SEQ ID NO: 3135 - DNA, 514 bp, Homo sapiens
  misc_feature: GYAE6OF01BUF13.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcaggcgggtctgagacagatttcactctcaccatcagcagcctgcaggctgaagatgtggctagtttattactgtcagcagttattatagttagtcctcgagttacgttttcgggacccggggaccaggcgtgggagactacaaacgactgtggctgcaccattctgtcttcacttccc

SEQ ID NO: 3136 - DNA, 501 bp, Homo sapiens
  misc_feature: GYAE6OF01BX1LI.39.31.C09.1.454.CMB.1.raw
  modified_base (292)..(292): a, c, t, g, unknown or other
  misc_feature (292)..(292): n is a, c, g, or t
  modified_base (497)..(497): a, c, t, g, unknown or other
  misc_feature (497)..(497): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtccctgaccgattcagcggcagcgggtctgagacagatttcactctcaccatcagcagcctgcaggctgaagatgtgctagtttatactgtcagcagtattatagtagtctcagtacgttttgggccggggacaaggcgtggagacgtacaaacgaactgtggctgcacctatctgtcttnatcc

SEQ ID NO: 3137 - DNA, 495 bp, Homo sapiens
  misc_feature: GYAE6OF01BWD10.39.31.C09.1.454.CMB.1.raw
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattactgtcagcagtattatagtagtcctcagtacttttggccggggtaccagctggagatcaaacgactgtaggctgcacatctntcttcntcc

SEQ ID NO: 3138 - DNA, 538 bp, Homo sapiens
  misc_feature: GYAE6OF01CJ4F8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacaacctcctaagtgctcatttactggcatctacccgggagtccggggtcctgaccgattcagcggcagcgggtctgagacagattcactctcaccatcagcagcctgcagctgaagatgtgcagtttatactgtcagcagtattatagtagtcctacagtacgttttggaccggggtactaaggcgtaggagtaagtaccgaaacgaacgttacggtggactcggacctaaccgaacttccgtagtacctttctacgttccgttacccccg

SEQ ID NO: 3139 - DNA, 506 bp, Homo sapiens
  misc_feature: GYAE6OF01CNRSN.39.31.C09.1.454.CMB.1.raw
  modified_base (498)..(498): a, c, t, g, unknown or other
  misc_feature (498)..(498): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgggagggccaccgatacgaactgcaagtccagccagagtgttttacacaggtccaaacaataagaattactcgcttggtaccagcagaaaccaggacagcctcctaagttgctcatttactgggcatctacccgggatcccggggtcctgaccgattcagcggcagcgggtctgagacagatttcactctcaccatcagcagcctgcagctgagatgtgcagttattactgtcagcagtatatagtagtcctacagtacgtttggccgggacaagctaggagagtacaaacgaactgtggctgacaccacgtactcgtcttctntctccccg

SEQ ID NO: 3140 - DNA, 498 bp, Homo sapiens
  misc_feature: GYAE6OF01EAWZ1.39.31.C09.1.454.CMB.1.raw
  modified_base (350)..(350): a, c, t, g, unknown or other
  misc_feature (350)..(350): n is a, c, g, or t
  modified_base (488)..(488): a, c, t, g, unknown or other
  misc_feature (488)..(488): n is a, c, g, or t
  modified_base (493)..(494): a, c, t, g, unknown or other
  misc_feature (493)..(494): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaaccaggacagcctcctaagttgctcatttactgggcatctacccgggagtccgggtccctgaccgattcagcggcagcggtctgagacngatttcactctcaccatcagcagcctgcagctgaagatgtggcagtttattactgtcagcagtattatagtagtcctcagtacgttttggccggggtaccaagctggagatacaaacgaactgtggctgcaccatctntcttnntccc

SEQ ID NO: 3141 - DNA, 578 bp, Homo sapiens
  misc_feature: GYAE6OF01C19DO.39.31.C09.1.454.CMB.1.raw
  modified_base (304)..(304): a, c, t, g, unknown or other
  misc_feature (304)..(304): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttacacgaggtccaaacaaataaagaattacttcgtcgttggtaaccagcaagaaaccaggacagcctactaagttgctctatttacgnggcatccgtacccgggacgtccggggtcctgaccgattcagcgcaggcggtctgagacagtatttcactctacaccatcagcacgcctgcgaggctagaagatggtgactagtttatactgtcagctagtattagtagtactcctacgtagttacgtttcggggacccggggtaacacggcgttacgggagtaacgtaaccgaaacgtaaccgttggtacggtccgttagacccaaccgtaacttcgttcggttaccttcctaactttcccccg

SEQ ID NO: 3142 - DNA, 520 bp, Homo sapiens
  misc_feature: GYAE6OF01EF6NL.39.31.C09.1.454.CMB.1.raw
  modified_base (514)..(514): a, c, t, g, unknown or other
  misc_feature (514)..(514): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagctagtattatagtagtcctcgtagtacgttttcgggaccggggtaaccaaggtcgtaggagtagtacgaaacgtactggtggctgacacctatctgtcttcnttcccg

SEQ ID NO: 3143 - DNA, 501 bp, Homo sapiens
  misc_feature: GYAE6OF01D5LMZ.39.31.C09.1.454.CMB.1.raw
  modified_base (292)..(292): a, c, t, g, unknown or other
  misc_feature (292)..(292): n is a, c, g, or t
  modified_base (497)..(497): a, c, t, g, unknown or other
  misc_feature (497)..(497): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtccctgaccgattcagcggcagcgggtctgagacagatttcactctcaccatcagcagcctgcaggctgaagatgtggctagtttattactgtcagcagtattatagtagtcctacagtacgttttggccggggaccagctggagatacaaacgactgtggctgcacctatactgtcttcntccg

SEQ ID NO: 3144 - DNA, 607 bp, Homo sapiens
  misc_feature: GYAE6OF01DDIS5.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcaagaaaccaggacagcctcctaagttgctctatttactggcatcctacccgggagtccggggtccctgaccgattcagcggcagcggtctgagacagatttcactctcacatcagcagcctgcaggctagaagatgtggactagtttattactgtacagctaagttattaataagtacgtacctacgtaacggttaccgttttacggggacccgggggtaaccctaagggtccgttagggaacgtaacgttaacccgaaaaaccggtaaccgttagggtacgggtccgttacgggaccctaacccgtaacttcccgttacggtttacctttaccgaaccgttttcccccg

SEQ ID NO: 3145 - DNA, 504 bp, Homo sapiens
  misc_feature: GYAE6OF01BB606.39.31.C09.1.454.CMB.1.raw
  modified_base (497)..(498): a, c, t, g, unknown or other
  misc_feature (497)..(498): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaacccaggacagcctcctaaagttgctcatttactgggcatctacccgggagtccggggtccctgaccgattcagcggcagcgggtctgagacagatttcactctcaccatcagcagcctgcaggctgaagatgtggcagtttattactgtcagcagtattatagtagtcctcagtacttttgggccggggtaccaagctggagatacgaaacgactgtggctgcaccatctgtcttnnttcccg

SEQ ID NO: 3146 - DNA, 515 bp, Homo sapiens
  misc_feature: GYAE6OF01BYVII.39.31.C09.1.454.CMB.1.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagtgctcatttacngggcatccgtacccgggagtcccggggtccctgaccgattcagcggcaggcgggtctgagacagactttcactctcaccatcagcagcctgcaggctgaagatgtggctagtttatactgtcagctagtattatagtagtcctctagtacgtttcgggccgggtacagcgtaggagatacgaaacgaactgtggctcgacacctattctgtcttcgtacttcccg

SEQ ID NO: 3147 - DNA, 561 bp, Homo sapiens
  misc_feature: GYAE6OF01EEBXR.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcagaaaccaggacagcctctaagttgctcatttacngggcatcctaccgggagtcccggggtccctgaccgattcagcggcagcgggtctgagacagatttcactctacaccatcagcagcctgcaggctagaagtatgtggactagtttattactgtcagctagttattaatagttacgtccttacgtagtacgttttcgggacccgggggtaaccaacggtcgtaggaagtactaaccgaaaacggtacgttaggtacggcttacgaccaacctattactagttactttaccgtctttaccccg

SEQ ID NO: 3148 - DNA, 574 bp, Homo sapiens
  misc_feature: GYAE6OF01B79PE.39.31.C09.1.454.CMB.1.raw
tcagtcgcactagtcacgaccggtgctcgatttagacgtctcatcaaggaaggaaggggcagcaagatggtgtagcagacccaggtcttcatttctctgttgctctggatctctggtgcctacggggacatcgtgatgacccagtctccagactccctggctgtgtctcgtgggcgagagggccaccatcaactgcaagtccagccagagtgtttacacaggtccaacaataagaattacttcgcttggtaccagcagaaaccaggacagcctcctaagttgctctatttactgggcatccgtacccgggagtccggggtccctgaccgattcagcggcagcgggtctgagacagtatttcactctcaccatcagcagcctgcaggctagaagatgtggctaggtttattacgtgtcagtactaagttattagtaagttacgtaccgttacgtacggttacgttttcggggacccggggtaacgtacggtccgtagggaacgtaacgtacgaaaaccggtacgtggtacggtcttcgacctaaccctagttcctagttccttctacgttccccg

SEQ ID NO: 3149 - DNA, 505 bp, Homo sapiens
  misc_feature: GYAE6OF01BPLXW.39.31.C09.1.454.CMB.1.raw
  modified_base (499)..(499): a, c, t, g, unknown or other
  misc_feature (499)..(499): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtcccggggtccctgaccgattcagcggcagcgggtctgagacagatttcactctcaccatcagcagcctgcaggctgaagatgtggctagtttattactgtcagcagttattatagtagtcctcagtacgtttgggccggggacagctggagagtacaaacgactgtggctcgcacctatctgtcttcgnttcccg

SEQ ID NO: 3150 - DNA, 505 bp, Homo sapiens
  misc_feature: GYAE6OF01D8WXQ.39.31.C09.1.454.CMB.1.raw
  modified_base (500)..(500): a, c, t, g, unknown or other
  misc_feature (500)..(500): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcagctgaagatgtggctagtttattactgtcagctagtattatagtagtctcagtacgtttgggccggggtacaagcgtggagtagtacgaaacgacgtgtggctgcacctatctgtcttcnttccc

SEQ ID NO: 3151 - DNA, 503 bp, Homo sapiens
  misc_feature: GYAE6OF01BEPUV.39.31.C09.1.454.CMB.1.raw
  modified_base (292)..(292): a, c, t, g, unknown or other
  misc_feature (292)..(292): n is a, c, g, or t
  modified_base (498)..(499): a, c, t, g, unknown or other
  misc_feature (498)..(499): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacnggcatctacccgggagtccggggtccctgaccgattcagcggcagcgggtctgagacagatttcactctcaccatcagcagcctgcaggctgaagatgtggctagtttattacgtgtcagctagtattatagtagtcctcgagtacgtttgggccggggacagcgtaggagatacgaaacgactgtggctgcacctatctgtcttnntccc

SEQ ID NO: 3152 - DNA, 522 bp, Homo sapiens
  misc_feature: GYAE6OF01DYBBO.39.31.C09.1.454.CMB.1.raw
  modified_base (349)..(349): a, c, t, g, unknown or other
  misc_feature (349)..(349): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttacacaggtccaacaataagaattacttcgcttggtaccagcagaaaccaggacagcctcctaagttgctctatttactgggcatcgtacccgggagtccgggtcctgaccgattcagcggcagcggtctgagacngatttcactctcacatcagcagcctgcaggctgaagatgtggactagtttattactgtcagactagtattatagtacgtcctactagtacgtttcgggaccggggtacagtcgtaggagactacgtaaacgaacgtgtggtcgtcgcaacctactactgtcttctcgttcccg

SEQ ID NO: 3153 - DNA, 507 bp, Homo sapiens
  misc_feature: GYAE6OF01CHJFL.39.31.C09.1.454.CMB.1.raw
  modified_base (465)..(465): a, c, t, g, unknown or other
  misc_feature (465)..(465): n is a, c, g, or t
  modified_base (501)..(501): a, c, t, g, unknown or other
  misc_feature (501)..(501): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctggaccgattcagcggcagcggtctgagacagatttcactctcaccatcagcagcctgcaggctgagatgtggactagtttattactgtcagcagtattatagtagtcctcagtacgttttggccggggaccagcgtggacgtanacaaacgacgtagtggctgcaccatctagtcttctnttcccg

SEQ ID NO: 3154 - DNA, 504 bp, Homo sapiens
  misc_feature: GYAE6OF01C3UH0.39.31.C09.1.454.CMB.1.raw
  modified_base (386)..(386): a, c, t, g, unknown or other
  misc_feature (386)..(386): n is a, c, g, or t
  modified_base (426)..(426): a, c, t, g, unknown or other
  misc_feature (426)..(426): n is a, c, g, or t
  modified_base (456)..(456): a, c, t, g, unknown or other
  misc_feature (456)..(456): n is a, c, g, or t
  modified_base (496)..(496): a, c, t, g, unknown or other
  misc_feature (496)..(496): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggatccggggtcctgaccgattcagcggcagcggtctgagacagatttcactctcaccatcagcagcctgcaggctgaagntgtggcagtttatactgtcagctagtattatagtatcctnagtactttgggccggggtacagcgtagganacgtcaaacgtaactgtggctgcaaccattctagtccttnacttcccg

SEQ ID NO: 3155 - DNA, 505 bp, Homo sapiens
  misc_feature: GYAE6OF01CHC1T.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtcccggggtccctgaccgattcagcggcagcgggtctgagacagatttcactctcaccatcagcagcctgcaggctgaagatgtggctagtttatactgtcagcagtattatagtagtcctcagtacgttttgggccggggtaccagcgtggagatacaaacgactggtaggctgacaccatctgtcttcattcccg

SEQ ID NO: 3156 - DNA, 503 bp, Homo sapiens
  misc_feature: GYAE6OF01ASI2R.39.31.C09.1.454.CMB.1.raw
  modified_base (429)..(429): a, c, t, g, unknown or other
  misc_feature (429)..(429): n is a, c, g, or t
  modified_base (490)..(490): a, c, t, g, unknown or other
  misc_feature (490)..(490): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtccctgaccgattcagcggcagcgggtctgagacagatttcactctcaccatcagcagcctgcaggctgaagatgtggctagtttatactgtcagcagtattatagtagtcctnagtacgttttggccggggtacagcgtggagatacgaaacgactggtggctcgcactatctntcttcacttcccg

SEQ ID NO: 3157 - DNA, 494 bp, Homo sapiens
  misc_feature: GYAE6OF01BFC8T.39.31.C09.1.454.CMB.1.raw
  modified_base (490)..(491): a, c, t, g, unknown or other
  misc_feature (490)..(491): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccggagtccggggtccctgaccgattcagcggcagcgggtctgagacagatttcactctcaccatcagcagcctgcaggctgaagatgtggcagtttattactgtcagcagtattatagtagtcctcagtactttggccggggaccagctggagatacaaacgaactgtggctgcaccatctgtcttnntcc

SEQ ID NO: 3158 - DNA, 684 bp, Homo sapiens
  misc_feature: GYAE6OF01BLGU9.39.31.C09.1.454.CMB.1.raw
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
tcagtcgcactagtcacgaccggtgctcgatttagacgtctcatcaaggaaggaaggggcacgcaacgagtggtcgttaggcagtacccaggtcttcatttctctgttgctactggatcgtctggtcgcctacggggactagtcgtgatgacccgtagtcttccagacctccgtggctcgtgttctcgtgggcgagagggcctaccgagtcgaacggtgctaaggtccgagggccagagtcgttttacacctaggtccaaacaagtaacgaagttacttcgnttggtaccagcagtaaaccgnggtacagccgtcctaagtgctcagtttacgngggcagtccgtaccgggngtcccgggtcctggaccgtattcgaggcggcaggtcggggtctggacgtacgaggtacttttccacgtcgtaccgacgtacttcgacgacgacgtcccttcgacgaacggactaacggaacgtaactacgtcggtactacggtttacttaccgtacgttacgtaggtacgtaagttaacgttaagtacgttacgtaccgtacgaacggttaccggtttacgggaccggggtaacctaacggttccgtagggaacgtaccgtacgtaaacggtaacgttaggtcggaccgttagacctacgtacgtacggttacgttcgttcgacgttccccg

SEQ ID NO: 3159 - DNA, 506 bp, Homo sapiens
  misc_feature: GYAE6OF01ETWMI.39.31.C09.1.454.CMB.1.raw
  modified_base (499)..(499): a, c, t, g, unknown or other
  misc_feature (499)..(499): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgctcatttactgggcatcgtacccgggagtccggggtccctgaccgattcagcggcagcggttctgagacagatttcactctcaccatcagcagcctgcaggctgaagatgtggctagtttattactgtcagcagtattatagtagtctcagtacgttttgggccggggacagctggagtatacgaaacgtacgtgtggctgcacctatctgtcttncttcccg

SEQ ID NO: 3160 - DNA, 495 bp, Homo sapiens
  misc_feature: GYAE6OF01CRDK3.39.31.C09.1.454.CMB.1.raw
  modified_base (489)..(489): a, c, t, g, unknown or other
  misc_feature (489)..(489): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggatccggggtccctgaccgattcagcggcagcggttctgagacagatttcactctacaccatcagcagcctgcagctgaagatgtggcagtttatactgtcagcagtatatagtatctcagtacttttggccggggtacagcgtaggagatacaaacgactgtaggctgcaccatctgtcttnattccg

SEQ ID NO: 3161 - DNA, 588 bp, Homo sapiens
  misc_feature: GYAE6OF01DDJWK.39.31.C09.1.454.CMB.1.raw
tcagtcgcactagtcacgaccggtgctcgatttagacgtctcatcaaggaaggaaggggcaggcaagatgggtgttgcagacccaggtcttcatttctctgttgtctctggatctctggtgcctacggggacatcgtgatgatcctagtctccagtacttccctggctgtgttctcgtgggcgagagggccaccatcaactgcaagtccgagccagagtgtttacacgaggtccaaacaataagaattacttcgcttggtaccagcaagaaaccaggacagccttaccttaagttcgctctactttactgggcctagtccgtaacccggggaggtcccggggtccctggacccgtattcaggtcggacaggtcgggtctggaagacagtaatttcactctcacatccagcagcctgacgaggcagaagtatagtagtactagttttattactgtacagtactaagttatttagtagtacgttcctagtagtacgttttcgggaccgggtacctaaggtcgtagggacgtacgaacgtaaacgtagttggtggtctacgacgtaacctattcgttacgttcttctaacc

SEQ ID NO: 3162 - DNA, 515 bp, Homo sapiens
  misc_feature: GYAE6OF01A2VMO.39.31.C09.1.454.CMB.1.raw
  modified_base (506)..(506): a, c, t, g, unknown or other
  misc_feature (506)..(506): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggactagtttattactgtcagcagttattatagtagtcctctagtacgtttgggccggggtacacggcgtggagatacgaaacgtactgtcggctagccactactctagtcttnacgttcccg

SEQ ID NO: 3163 - DNA, 561 bp, Homo sapiens
  misc_feature: GYAE6OF01COJIQ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcaagaaacaggaaacgcctactaagtgctcattactgggcatcgtaccgggacgtccgggtccctgaccgattcgagcggcaggcggtctgagacagtatttcactctcaccatcagcagcctgcaggctagaagagtgtggactagtttattactgtcagtctaagttatatagtactacctagtacgttacgtttcgggacccggggaactaaggcgtaggaagtacgtaaccgaaacggtaacgtggtacggacgtcgaccgacctacgttccttacgttctttacgacttcccgttacccccg

SEQ ID NO: 3164 - DNA, 613 bp, Homo sapiens
  misc_feature: GYAE6OF01DV7X6.39.31.C09.1.454.CMB.1.raw
  modified_base (295)..(295): a, c, t, g, unknown or other
  misc_feature (295)..(295): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttacacaggtccaaacaataagaattacttcgcttggtaccagcagaaaccaggacacgcctcctaagttgctctatttacgnggcatccgtacccgggagtcccgggtcctgaccgtattcgagcggcagcgggtctggagacagtatttcactctcacatcagcagcctgcaggctacgaagtagtggtggtacctagtttacttactcgtacacgtactaagtttattaagttaagtacgtacccttacgtaaggttaccgttttacgggacccggggggtaacctaacggtacgttagggaacgtaacgtaaccgtaaaacggtaaccgtaggtacggtccttacggaccctaacccgtacgttcccttacggttcctttaccgacgtttacccccg

SEQ ID NO: 3165 - DNA, 563 bp, Homo sapiens
  misc_feature: GYAE6OF01CR7NP.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcagaaaccaggacagcctcctaagttgctcatttacnggcatccgtacccgggagtcccggggtccctgaccgattcagcggcaggcggtctgagacagtatttcactctcaccatcagcagcctgcaggctagaagatgtggactagtttatactgtcagtctagttaattatagttacgtcctcgtaagttacgttttcggggacccggggtaacctacggcgtaggaacgtacgtacgaaaacgtacgtaggtcggtcctacggacctaaccgtacttacttcgttaccttcgtaacgttccccg

SEQ ID NO: 3166 - DNA, 579 bp, Homo sapiens
  misc_feature: GYAE6OF01DKCX8.39.31.C09.1.454.CMB.1.raw
  modified_base (292)..(292): a, c, t, g, unknown or other
  misc_feature (292)..(292): n is a, c, g, or t
  modified_base (371)..(371): a, c, t, g, unknown or other
  misc_feature (371)..(371): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacnggcatctacccgggagtcccggggtccctgaccattcagccggcagcgggtctgagacagatttcactctcaccatcancagcctgcaggctgaagatgtaggctagtttatactgtcagtctagtattattagtacgttccctagtacgttacgttttcgggacccggggtaaccaacggtcgtacgggtaagtaacgtaaccgaaaacggtaaaccgttagggtacgggtaccgttacgaccaaacccgtactttcgttacgttctttccgtacgtttacccccg

SEQ ID NO: 3167 - DNA, 564 bp, Homo sapiens
  misc_feature: GYAE6OF01DKM71.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggcccaccatcaactgcaagtccagtcagagttgttttacacaggtaccaaacaataagaattacttcgcttggtaccagcaagaaaccagacagcctactaagttgctctatttacgtggcatccgtacccgggacgtcccggggtccctcgaccgtattcacggcggcaggcgggtctagagacgagtatttccactctacaccatcagcacgcctagcgaggctagaagtatggtggtactagtttactactgtacagactaagttattatacgtctacctacgtagttacggttcggtaccggggtacgacgacgtgagactaacgtaacgtaacgtgtacggtcgtacgacacctacttacgtacgtcttctcgttcccg

SEQ ID NO: 3168 - DNA, 513 bp, Homo sapiens
  misc_feature: GYAE6OF01A42AK.39.31.C09.1.454.CMB.1.raw
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcctacccgggagtccggggtccctgaccgattcagcggcagcgggtctgagacagatttcactctcaccatcagcacgcctgcaggctgaagatgtggctagtttattactgtcagcagtattatagtagtacctcgagtacgttttgggccggggtacacggcgtggagtatacaaacgtaactgtggctgacaccatctntcttcngttcccg

SEQ ID NO: 3169 - DNA, 535 bp, Homo sapiens
  misc_feature: GYAE6OF01B50OI.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtcccggggtccctgaccgattcagcggcaggcgggtctgagacagatttcactctcaccatcagcagcctgcaggctgaagatgtggtctagtttattactgtcagtcagttattagtagtagttcctctagttacgtttgggcccggggtaccaagcgtggagacttacgaaacgtaacgtggtaggcctgaccacctattccgttagttccttcgtcttccccg

SEQ ID NO: 3170 - DNA, 591 bp, Homo sapiens
  misc_feature: GYAE6OF01DRN81.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaaacaataaagaattacttcgcttggtaccagcaagaaaccaggacacgcctacctaagttgctctatttacgtggcatccgtacccgggagtccgggtcctgaccgtattcgagcgcaggcggtctgagacagtatttcactctcaccatcagcacgcctgcgagtctagaagtatggtgtacgtagtttacttacgtcgtacagtcgtaagtttatttaagtacgttacgttaccgttacgtacgttacggttttcgggacccggggtaacaaggtccgtaggacgtaacgtaacgaaaccgtacgttaggacggtcgtcgaccaccgttaacgttcgttacgttactttcctcgttaccccg

SEQ ID NO: 3171 - DNA, 520 bp, Homo sapiens
  misc_feature: GYAE6OF01C4XEZ.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacnggcatctacccggagtccggggtccctgaccgattcagcggcagcgggtctgagacagatttcactctcaccatcagcacgcctgcagctgaagatgtggactagttattactgtcagcagttatatagtacgtctacgagtacgtttcgggccggggtaacaggtcgtaggagagtacgaaacgaacgtgtaggcgtcgaccacctactctgtcttctacgttcccg

SEQ ID NO: 3172 - DNA, 553 bp, Homo sapiens
  misc_feature: GYAE6OF01CCP0Q.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtcccggggtccctgaccgattcagcggcagcgggtctgagacagatttcactctcaccatcagcagcctgcaggctagaagatgtggctagtttattactgtcagctaagttatttaagtagtacgtccttacgagtacgttttcgggacccgggggtaaccaggtcgtagggagtacgtacgaaaccgtacgtggtacgggcttacggaccaccgtatccttagttcctttcgcgtttccccg

SEQ ID NO: 3173 - DNA, 533 bp, Homo sapiens
  misc_feature: GYAE6OF01ERGKG.39.31.C09.1.454.CMB.1.raw
  modified_base (511)..(511): a, c, t, g, unknown or other
  misc_feature (511)..(511): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagtatttcactctcaccatcagcagcctgcgaggctgaagatgtgctagtttattactgtcagcagttattatagttagtcttcgagttacgttttcgggaccggggtaacaaggcgtaggagtacgtacgaaacgtacgtaggtggcgtacggcaaccgtnttctagttcttcgtacttcccg

SEQ ID NO: 3174 - DNA, 500 bp, Homo sapiens
  misc_feature: GYAE6OF01DLUJU.39.31.C09.1.454.CMB.1.raw
  modified_base (495)..(495): a, c, t, g, unknown or other
  misc_feature (495)..(495): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaaagttgctcatttactgggcatctacccgggagtccggggtccctgaccgattcagcggcagcgggtctgagacagatttcactctcaccatcagcagcctgcaggctgaagatgtggcagtttatactgtcagcagtattatagtagtcctcagtacttttgggccggggacaagctggagatacaaacgactagtggctgcaccatctgttcttcntcccg

SEQ ID NO: 3175 - DNA, 528 bp, Homo sapiens
  misc_feature: GYAE6OF01CAKJY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcgtacccgggagtccggggtccctgaccgattcagcggcagcgggtctgagacagatttcactctcaccatcagcagcctgcaggctgaagatgtggactagtttatactgtcagctagtattatagtagtcctacgtagtacgttttgggacccggggtaccaggcgtaggagacgtacgaaacgtactggtcggctgaccacctacttactgtccttcgcttaccccg

SEQ ID NO: 3176 - DNA, 508 bp, Homo sapiens
  misc_feature: GYAE6OF01ATANM.39.31.C09.1.454.CMB.1.raw
  modified_base (503)..(503): a, c, t, g, unknown or other
  misc_feature (503)..(503): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtgctagtttattactgtcagcagtattatagtagtcctctagtacgttttggaccggggtaccaagcgtggagtatacaaacgtactgtaggctcgcacctatctagtcttctnttccc

SEQ ID NO: 3177 - DNA, 562 bp, Homo sapiens
  misc_feature: GYAE6OF01DUKJU.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaataagaattactcgcttggtaccagcaagaaaccaggacagacctacctaagtgctctatttactggcacgtccgtacccgggagtcccggggtcctgaccgattcgagcggcagcggtctgagacagtatttcactctacacatcagtcacgcctgcaggctagaagtagtgtggtactagtttatacgtgtcagctagttaattatagtactcctacgacgtacgtttcgggacgggtactaggcgtaggaagtacgtaaaccgaaacgtacgttaggtacggtcgtacgaccaccgtacgttcctacggttccttcgtacttccccg

SEQ ID NO: 3178 - DNA, 499 bp, Homo sapiens
  misc_feature: GYAE6OF01AS5CU.39.31.C09.1.454.CMB.1.raw
  modified_base (429)..(429): a, c, t, g, unknown or other
  misc_feature (429)..(429): n is a, c, g, or t
  modified_base (492)..(493): a, c, t, g, unknown or other
  misc_feature (492)..(493): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtccctgaccgattcagcggcagcgggtctgagacagatttcactctcaccatcagcagcctgcaggctagaagatgtggctagtttatactgtcagcagtattatagtatcctnagtacgtttggccgggtacagctaggagatacgaaacgtactgtggctgcaccatctgtcttnnttcccg

SEQ ID NO: 3179 - DNA, 510 bp, Homo sapiens
  misc_feature: GYAE6OF01A7D20.39.31.C09.1.454.CMB.1.raw
  modified_base (428)..(428): a, c, t, g, unknown or other
  misc_feature (428)..(428): n is a, c, g, or t
  modified_base (480)..(480): a, c, t, g, unknown or other
  misc_feature (480)..(480): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagttgctcatttactgggcatctacccgggagtccgggtccctgaccgattcagcggcagcgggtctgagacagatttcgactctcaccatcagcagccctgcaggctgaagatgtggctagtttatatgtcagcagtattatagtagtaccncgagtacgttttggccggggaccaagctggagtagtacgaaacgacgtaggnggctgacaccattctagtcttcgattcccg

SEQ ID NO: 3180 - DNA, 502 bp, Homo sapiens
  misc_feature: GYAE6OF01AFSY4.39.31.C09.1.454.CMB.1.raw
  modified_base (497)..(497): a, c, t, g, unknown or other
  misc_feature (497)..(497): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtcccggggtccctgaccgattcagcggcagcgggtctgagacagatttcactctcaccatcagcagcctgcaggctgaagatgtggctagtttattactgtcagcagtattatagtagtcctcagtacgtttgggccggggaccagcgtggagatacaaacgactgtggctgcacctatctgtcttcnttccc

SEQ ID NO: 3181 - DNA, 508 bp, Homo sapiens
  misc_feature: GYAE6OF01AZSKJ.39.31.C09.1.454.CMB.1.raw
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtacgttttgggaccggggtaccagcgtggagtagtacgaaacgtactgtggctgcacctatctgtcttntntcccg

SEQ ID NO: 3182 - DNA, 521 bp, Homo sapiens
  misc_feature: GYAE6OF01CG6RO.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattactcgcttggtaccagcagaaaccaggacagcctcctaagttgctcatttactgggcatccgtacccgggagtcccggggtccctggaccgattcagcggcagcgggtctgagacagatttcactcacaccatcagcacgcctgcagctagaagagtgtggactagtttatactgtcagctagtattatagtcgtcctgtagtacgtttgggaccgggacaagcgtaggacgatacgaaacgtactggtcggctcgacactattctgtccttcgacttcccg

SEQ ID NO: 3183 - DNA, 527 bp, Homo sapiens
  misc_feature: GYAE6OF01CFF24.39.31.C09.1.454.CMB.1.raw
  modified_base (518)..(518): a, c, t, g, unknown or other
  misc_feature (518)..(518): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctcatttactgggcatccgtacccgggagtccggggtccctgaccgattcagcgcagcggtctgagacagatttcactctcacatcagcagcctgcaggctagaagatgtggctagtttattactgtcagctagtattatagtacgtcctacgtagtacgttttcgggacccggggtaaccagtcgtaggagtagtacgaaacgactaggtcggctagcacgtatctgttccttntacttcccg

SEQ ID NO: 3184 - DNA, 543 bp, Homo sapiens
  misc_feature: GYAE6OF01CC9XS.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcagaaaccaggacagcctcctaagttgctcatttactggcatccgtacccgggagtccggggtccctgaccgattcagcggcagcgggtctgagacagatttcactctcaccatcagcagcctgcaggctgaagatggtggactagtttatactgtacagctaagtattaatagtacgtcctactagtacgttttcgggacccggggtaactaaggccgtagggagtaagtaccgaaaacgaacgtggtggcttgaccacctactacgtgttccttctacttccccg

SEQ ID NO: 3185 - DNA, 519 bp, Homo sapiens
  misc_feature: GYAE6OF01CGF0W.39.31.C09.1.454.CMB.1.raw
  modified_base (442)..(442): a, c, t, g, unknown or other
  misc_feature (442)..(442): n is a, c, g, or t
  modified_base (514)..(514): a, c, t, g, unknown or other
  misc_feature (514)..(514): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctacctaagttgctcatttactgggcatccgtacccgggagtcccggggtccctgacccgattcgagcggcaggcgggtctgagacagatttcactctcaccatcagcagcctgcaggctagaagatggtggactagtttatactgtacagctagtattatagtactcctnagtacgtttcgggacccggggtaacaggctaggagatacgaaacgtactgtggctgacacatactgttctcnttccc

SEQ ID NO: 3186 - DNA, 575 bp, Homo sapiens
  misc_feature: GYAE6OF01CFXT0.39.31.C09.1.454.CMB.1.raw
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagttgttttacacaggtaccaacaataagaattactcgcttggtaccagcaagaaaccaggacagcctacctaagttgctcatttacnggcatccgtacccgggagtcccggggtcctgaccgattcgagcggcaggcggtctgagacagtactttcactctcaccatcagcagcctgcaggctagaagatgtggactagtttattactgtacagcagttattatagtactcctacgacgttacgtttcggggacccggggtaacacggtcgtagggagtaacgtaaccgaaaacggtaaccgttggtacggtcgttacggaccctaacccgtagttccgttagttccctttcgcgtttacccccgg

SEQ ID NO: 3187 - DNA, 519 bp, Homo sapiens
  misc_feature: GYAE6OF01BTFZO.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtcccggggtccctgaccgattcagcgcagcggtctgagacagatttcactctcaccatcagcagcctgcaggctgaagatgtggactagtttatactgtcagctagtattatagtacgtcctacagtacgtttcgggaccgggtacagtcgtaggagagtacgaaacgtacgtgtcggctcgaccacctatctagttcttcgacttcccg

SEQ ID NO: 3188 - DNA, 526 bp, Homo sapiens
  misc_feature: GYAE6OF01A9DRK.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctcatttacnggcatcgtacccgggagtccggggtccctgaccgattcagcggcagcgggtctgagacagtatttcactctcaccatcagcagcctgcaggctagaagatgtggactagtttattacgtgtcagctagttattatagtacgtcctcgtagtacgtttcgggaccgggtacaggcgtaggagacgtacgaaacgacgtgtggtctagccacctactctgtccttctcttccccg

SEQ ID NO: 3189 - DNA, 544 bp, Homo sapiens
  misc_feature: GYAE6OF01AL6LV.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctctaagttgctcattactggcatccgtacccgggagtccgggtccctgaccgattcagcggcagcggtctgagacagatttcactctcaccatcagcagcctgcaggctagaagatgtgactagtttatacgtgtcagctagtattatagtacgtcctactagtacgttttcgggaccggggtaaccaggtcgtagggacgtagtaccgaaaacgtacgtaggtacggtctacgacctaccgtacttacgttacgttccttcgtcttaccccg

SEQ ID NO: 3190 - DNA, 519 bp, Homo sapiens
  misc_feature: GYAE6OF01DVUP6.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctctaagttgctcatttactggcatctacccgggagtccggggtcctgaccgtatcagcggcagtggtctgagacagatttcactctcaccatcagcagcctgcaggctgaagatgtggctagtttattacgtgtcagcagtattatagtacgtcctcgtacgtacgttttgggccggggtacgaagcgtaggagagtacgaaacgtaacgtgtggtctacgcaacctactctgtcttcagttcccg

SEQ ID NO: 3191 - DNA, 497 bp, Homo sapiens
  misc_feature: GYAE6OF01B0WNL.39.31.C09.1.454.CMB.1.raw
  modified_base (455)..(455): a, c, t, g, unknown or other
  misc_feature (455)..(455): n is a, c, g, or t
  modified_base (491)..(491): a, c, t, g, unknown or other
  misc_feature (491)..(491): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttatactgtcagcagtattatagtatcctcagtacttttgggcggggacaagctgganatacaaacgtactgtggctgcacctatctgtcttcnttcccg

SEQ ID NO: 3192 - DNA, 509 bp, Homo sapiens
  misc_feature: GYAE6OF01BZDPE.39.31.C09.1.454.CMB.1.raw
  modified_base (503)..(503): a, c, t, g, unknown or other
  misc_feature (503)..(503): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttatactgtcagcagtattatagtagtcctcgtacgtacgttttgggccggggaccaggtctggagagtacgaaacgacgtggtggctgcaccatctgtcttcngttccc

SEQ ID NO: 3193 - DNA, 607 bp, Homo sapiens
  misc_feature: GYAE6OF01BNGB7.39.31.C09.1.454.CMB.1.raw
  modified_base (357)..(357): a, c, t, g, unknown or other
  misc_feature (357)..(357): n is a, c, g, or t
  modified_base (397)..(397): a, c, t, g, unknown or other
  misc_feature (397)..(397): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggactagcctcctaagttgctctatttactgggcatcctacccgggagtcccggggtccctgaccgattcagcggcagtccggtctgagacngtatttcactctcaccatcagcagcctgcaggctagaagntagtggactagtttattactgtcagtcagttattaagtacgttacgtccttacgtaagttacgttttacggggacccggggtaacccaagggtccgttagggaagtaccgtaacggtaaaaaccggtaacgttagggttacgggtacccgtagggacccctaacccgtacgtttaccttaccggtttccttaccgtaaccgtttcccccg

SEQ ID NO: 3194 - DNA, 513 bp, Homo sapiens
  misc_feature: GYAE6OF01DA7ZG.39.31.C09.1.454.CMB.1.raw
  modified_base (506)..(506): a, c, t, g, unknown or other
  misc_feature (506)..(506): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctctaagttgctcatttactggcatccgtacccgggagtccggggtccctgaccgattcagcggcagcggtctgagacagatttcactctcaccatcagcagcctgcgaggctagaagatgtggacgtagtttattactgtcagcagtattatagtatctactgtcgtttgggccgggtacagcgtaggagatacaaacgtacgtgtcggctcgaccacctattctgttcttcngttcccg

SEQ ID NO: 3195 - DNA, 520 bp, Homo sapiens
  misc_feature: GYAE6OF01EFYCU.39.31.C09.1.454.CMB.1.raw
  modified_base (424)..(424): a, c, t, g, unknown or other
  misc_feature (424)..(424): n is a, c, g, or t
  modified_base (514)..(514): a, c, t, g, unknown or other
  misc_feature (514)..(514): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaaagttgctcatttactgggcatctacccgggagtccggggtccctgaccgattcagcggcagcgggtctgagacagatttcactctcaccatcagcagcctgcaggctgaagatgtggctagtttattactgtcagctagttattanagttagtcctactagtacgttttgggaccggggaccgaagcgtaggagatacgaaacgaacgtagtggctgcacctactactgttcttcnttcccg

SEQ ID NO: 3196 - DNA, 504 bp, Homo sapiens
  misc_feature: GYAE6OF01AJNVW.39.31.C09.1.454.CMB.1.raw
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccggagtccggggtccctgaccgattcagcggcagcggtctgagacagatttcactctcaccatcagcacgcctgcaggctgaagatgtggctagttattacgtgtcagcagtattatagtagtcctcgagtacgttttgggccggggaccaggctggagatacaaacgtactgtggctgcacctntcttntcttctntccc

SEQ ID NO: 3197 - DNA, 618 bp, Homo sapiens
  misc_feature: GYAE6OF01EAMNU.39.31.C09.1.454.CMB.1.raw
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtccaaacaataagaattacttcgcttggtaccagcaagaaaccaggacagcctacctaagttgctctatttacngggcatccgtacccgggagtcccggggtccctgaccgattcgagcggcagcggtctgagacagtatttcactctcaccatcagcagcctgcaggctagaagatgtggtactagtttattactgtcagtactaagttaattattaggtacgttacctacgtaacggttacgtttttacggggacccggggtaaccgtaacggtaccgtagggtaacgtaacgtaaccgtaaaaccggtaacgttagggttacgggtccgttacggtaacccaacccgttacgttaccgttacgtttacctttcccgtaaccgtttaccccccg

SEQ ID NO: 3198 - DNA, 525 bp, Homo sapiens
  misc_feature: GYAE6OF01AQA8S.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctagaagatgtggctagtttattactgtcagcagttattatagtatcctctagtaccgttttgggacccggggtaccagcgtggagtactacgaaacggtacgtggtggtctcgcaccgtactacgttgtccttcgcttcccg

SEQ ID NO: 3199 - DNA, 617 bp, Homo sapiens
  misc_feature: GYAE6OF01D0MOS.39.31.C09.1.454.CMB.1.raw
  modified_base (372)..(372): a, c, t, g, unknown or other
  misc_feature (372)..(372): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaataagtaattacttcgcttaggtaaccagacaacgaaaccgaggaacagacctaccttaagttcgctctatttacgtgggactagtccgtacccgggagttcccggggtccctggaccgtattcacgcggcaggcggtcngagacagtatttcactctaccacctatcagccacgcctcgcgaggtctagaagtagtggtacggtacgttagttttacttacgtgtacgagtacgtaagttaatttagtaagtacgttacctacgtaacgttacggttttacgggacccggggtaacctacgtcgtagggacgtagtaaccgtaaacggtacgtaggtacggtcgtacgacaccgtacttactgtttaccttcgtcgttaccccg

SEQ ID NO: 3200 - DNA, 506 bp, Homo sapiens
  misc_feature: GYAE6OF01EJ7DL.39.31.C09.1.454.CMB.1.raw
  modified_base (431)..(431): a, c, t, g, unknown or other
  misc_feature (431)..(431): n is a, c, g, or t
  modified_base (494)..(494): a, c, t, g, unknown or other
  misc_feature (494)..(494): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctggagacagatttcactctcaccatcagcagcctgcaggctgaagatgtggctagtttattatgtcagcagtattatagtagtcctnagtacgtttgggccggggtacaagcgtaggagatacaaacgactagaggctgacacctatctntcttctatcccg

SEQ ID NO: 3201 - DNA, 516 bp, Homo sapiens
  misc_feature: GYAE6OF01AI1MX.39.31.C09.1.454.CMB.1.raw
  modified_base (510)..(510): a, c, t, g, unknown or other
  misc_feature (510)..(510): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagtatttcactctcaccatcagcagcctgcaggctgagatgtggctagtttattactgtcagcagtattatagtacgtacctcgtagtacgtttcgggccggggtacaggcgtggagtatacgaaacgtacgtgtcggctcgacacgtactctgtcttcnttcccg

SEQ ID NO: 3202 - DNA, 519 bp, Homo sapiens
  misc_feature: GYAE6OF01CBR0U.39.31.C09.1.454.CMB.1.raw
  modified_base (513)..(513): a, c, t, g, unknown or other
  misc_feature (513)..(513): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcagaaaccaggacagcctcctaagttcgctcatttactggcatccgtacccggagtccggggtccctgaccgattcagcggcaggcggtctgagacagtatttcactctcaccatcagcagcctgcaggctgaagatggtgactagtttatactgtcagctagtattatagtagtcctagtacgtacgtttcgggccggggtacagcgtaggagatacgaaacgtactggtaggctcgacacctactctgttcttcncttccc

SEQ ID NO: 3203 - DNA, 497 bp, Homo sapiens
  misc_feature: GYAE6OF01BWGVT.39.31.C09.1.454.CMB.1.raw
  modified_base (491)..(491): a, c, t, g, unknown or other
  misc_feature (491)..(491): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcagctgaagatgtgcagtttatactgtcagcagttattatagtagtcctcagtacgtttcggccggggacagctggagatacaaacgactgtggctgcacctatctgtcttcnttcccg

SEQ ID NO: 3204 - DNA, 512 bp, Homo sapiens
  misc_feature: GYAE6OF01EOP8V.39.31.C09.1.454.CMB.1.raw
  modified_base (507)..(508): a, c, t, g, unknown or other
  misc_feature (507)..(508): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcgagcggcaggcgggtctgagacagatttcactctcaccatcagcagcctgcaggctagaagatgtggctagtttattactgtcagtcagttattatagtacgtacctcgtagtacgttttggccggggaccaggcgtaggagatacaaacgtactgtggctgcacctatctgtcttnntccc

SEQ ID NO: 3205 - DNA, 501 bp, Homo sapiens
  misc_feature: GYAE6OF01D6V1S.39.31.C09.1.454.CMB.1.raw
  modified_base (496)..(496): a, c, t, g, unknown or other
  misc_feature (496)..(496): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtactttgggccggggaccagctggagatacgaaacgactgtggctgcacctatctgttcttcntcccg

SEQ ID NO: 3206 - DNA, 508 bp, Homo sapiens
  misc_feature: GYAE6OF01BBQ6L.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaacccaggacagcctcctaagttgctcatttactgggcatctacccgggagtccggggtccctgaccgattcagcggcagcggtctgagacagatttcactctcaccatcagcagcctgcaggctgagatgtggcagtttattactgtctagctagtacttatagtagtcctgagtacgttttggccgggaccaagcctggagagtacgaaacgaactgtagctgcactatacttgtcttcattcccg

SEQ ID NO: 3207 - DNA, 513 bp, Homo sapiens
  misc_feature: GYAE6OF01DG6NT.39.31.C09.1.454.CMB.1.raw
  modified_base (505)..(505): a, c, t, g, unknown or other
  misc_feature (505)..(505): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacgtggcatcgtacccgggagtcccggggtcctgaccgattcagcggcagcggtctgagacagatttcactctcaccatcagcagcctgcaggctgaagatgtggtctagtttattactgtcagctagtattatagtagtcctctagtactttgggaccggggacagcgtaggagactacgaaacgtaactggtacggctgcacctatactgtctntacttccc

SEQ ID NO: 3208 - DNA, 506 bp, Homo sapiens
  misc_feature: GYAE6OF01BYXR2.39.31.C09.1.454.CMB.1.raw
  modified_base (500)..(500): a, c, t, g, unknown or other
  misc_feature (500)..(500): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagttattatagtagtcctcagtacttttggccggggaccaagcgtggagtatacaaacgacgtgtggtcgtgcaccatctgtcttcnttcccg

SEQ ID NO: 3209 - DNA, 548 bp, Homo sapiens
  misc_feature: GYAE6OF01BU958.39.31.C09.1.454.CMB.1.raw
  modified_base (358)..(358): a, c, t, g, unknown or other
  misc_feature (358)..(358): n is a, c, g, or t
  modified_base (410)..(410): a, c, t, g, unknown or other
  misc_feature (410)..(410): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacagtccaaacaataagaattactcgcttggtaccagcaagaaaccaggacagcctcctaagttgctcatttactggcatctaccggagtcccgggtcctgaccgattcagcggcaggcggtctgagacagtatttcactcncacatcacgcagcctgcagctagaagagtagtggactagtttattacgtgtnagctagtattagtacgtacgtcctacgtacgtacgttttcggaccggggtacgaacgtacgtaggagtaacgtaacgaaacgtaacgtaggtcggcgtacgaccaaccgtacttcgttacttcttcgtcgttaccccg

SEQ ID NO: 3210 - DNA, 556 bp, Homo sapiens
  misc_feature: GYAE6OF01C308T.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctctatttactgggcatcgtacccgggagtccggggtccctgaccgattcagcggcaggcgggtctgagacagtatttcactctcaccatcagcagcctgcaggctgaagatgtaggctagtttattactgtcagctagttattatagtacgtcctcgtacgtacgttttcgggccgggggtaacaggtcgtagggagtacgtaccgtaaaacggaacgttggtcggtctacggaccaacccgtattccttaggtttccttccgtacttaccccg

SEQ ID NO: 3211 - DNA, 503 bp, Homo sapiens
  misc_feature: GYAE6OF01DRV3A.39.31.C09.1.454.CMB.1.raw
  modified_base (500)..(500): a, c, t, g, unknown or other
  misc_feature (500)..(500): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaaactgcaagtccagccagagtgttttacacaggtccaacaaataagaattactcgcttggtaccagcaagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagctagtattatagtagtcctatagtacgtttgggccgggacagcgtaggagatacaaacgtactgtaggctgcactatctgtctctntcc

SEQ ID NO: 3212 - DNA, 566 bp, Homo sapiens
  misc_feature: GYAE6OF01BPZ94.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaataagtaattacttcgacttggtaccagcaagaaaccgagacagcctacctaagttgctcatttacgtggcatccgtacccgggagtcccgggtcctgaccgtatcagcgcgaggcggtctgagacagtactttcactctacacatcgagcacgcctgcgagtcagaagtgtgtcggactagtttattacgtgtcagcgtagttattaatagtacgtcctagtacgtacgtttcgggaccgggtacgaggtcgtaggacgtacgtaacgtaaaacgtacgtaggtacggtctacgacctaccgtacgttcttacgtcctttagtcgttaccccg

SEQ ID NO: 3213 - DNA, 506 bp, Homo sapiens
  misc_feature: GYAE6OF01E2IFU.39.31.C09.1.454.CMB.1.raw
  modified_base (292)..(292): a, c, t, g, unknown or other
  misc_feature (292)..(292): n is a, c, g, or t
  modified_base (430)..(430): a, c, t, g, unknown or other
  misc_feature (430)..(430): n is a, c, g, or t
  modified_base (463)..(463): a, c, t, g, unknown or other
  misc_feature (463)..(463): n is a, c, g, or t
  modified_base (478)..(478): a, c, t, g, unknown or other
  misc_feature (478)..(478): n is a, c, g, or t
  modified_base (500)..(500): a, c, t, g, unknown or other
  misc_feature (500)..(500): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtccctgaccgattcagcggcagcgggtctgagacagatttcactctcaccatcagcagcctgcaggctgaagatgtggctagtttatactgtcagcagtattatagtagtcctnagtacttttgggaccggggtaccaaggctgganagtacaaacgactgnggctgacaccatctagtcttcnttcccg

SEQ ID NO: 3214 - DNA, 764 bp, Homo sapiens
  misc_feature: GYAE6OF01BYXBD.39.31.C09.1.454.CMB.1.raw
  modified_base (347)..(347): a, c, t, g, unknown or other
  misc_feature (347)..(347): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccgagcctccgtgctgtcgtctcggtgggcgaggacggcccacactacaacgtgacgtaacgtccgacgaccgaaggtaggttttacgtttaaccaacgtaccggtaacccaaactaaagtaaagtaactttaccgtccgtcgtttaccggtaaccagacgaaacgaaaccggacgaacacgtccctaaccgttaagtcnctacttaactttacgggcggactacttaccccgggtaacccggggtacgggttccccggggtcctacggaaccgttactacgacggccggacgacgggtcggttcaggacgacgtagttacttaccgacttcctaccaccgtactacgacgacacgtccgtcgacggacgtcgtaaggaagtagttgggtcgtaccgtttagttttaccttcgtcgtacgacgtacgttaagtttatttaagtacgttccgttacctacgtaacgggttttacgggtttcccgggggaccgggtaaacctaggttaccggtagggtaactaaaccgtaaaccggaaaaacgtcggttggggtacggtccgttacggaacctaacccgtattccggttacgtttacccttcgtaccgtttccccccgg

SEQ ID NO: 3215 - DNA, 550 bp, Homo sapiens
  misc_feature: GYAE6OF01A66AN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcagcgggtctgagacagatttcactctcaccatcagcagcctgcaggctgaagatgtggctagtttatactgtacagctagttattatagtacgtcctcgtagtacgttttacgggaccggggtacaaggtcgtagggagtaacgtacgaaaacgtaacgttggtacggctacggacacccgtaattcccgttagttccctttcgacgtttccccg

SEQ ID NO: 3216 - DNA, 500 bp, Homo sapiens
  misc_feature: GYAE6OF01CBA6H.39.31.C09.1.454.CMB.1.raw
  modified_base (474)..(474): a, c, t, g, unknown or other
  misc_feature (474)..(474): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaaccaggacagcctcctaagttgctcatttactgggcatctacccgggagtccggggtccctgaccgattcagcggcagcggtctgagacagatttcactctcaccatcagcagcctgcaggctgaagatgtggctagtttatactgtcagcagttattatagtagtcctcagtacttttggcccggggacagcgtggagagtacaaacgactgnggctgcaccatctgtcttcattcccg

SEQ ID NO: 3217 - DNA, 504 bp, Homo sapiens
  misc_feature: GYAE6OF01EHR2I.39.31.C09.1.454.CMB.1.raw
  modified_base (292)..(292): a, c, t, g, unknown or other
  misc_feature (292)..(292): n is a, c, g, or t
  modified_base (429)..(429): a, c, t, g, unknown or other
  misc_feature (429)..(429): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
tcagtcgcactagtcacgaccggtgctcgatttagacgtctcatcaaggaaggaaggggcagcaagatggtgttgcagacccaggtcttcatttctctgttactctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccgggtccctgaccgattcagcgcagcggtctgagacagatttcactctcaccatcagcagccctgcaggctgaagatgtgctagtttattactgtcagctagtattatagtagtcctntagtacgtttggaccggggtacaagcgtgagatacaaacgacgtgtgctgcacnctctntcttctctcgttcccg

SEQ ID NO: 3218 - DNA, 538 bp, Homo sapiens
  misc_feature: GYAE6OF01CD9ZG.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcaagaaaccaggacagcctcctaagttgctcatttactgggcatccgtacccgggagtccggggtccctgaccgattcagcggcagcgggtctgagacagatttcactctcaccatcagcagcctgcaggctagaagtatggtggctagtttattactgtcagtctaagttattaatagtacgttcctctaaggtaccgttttcgggacccggggtaaccaggtcgtaggagtacgtacgaaacgtacgtggtcggtctgccactactctgttcttcgacttccc

SEQ ID NO: 3219 - DNA, 494 bp, Homo sapiens
  misc_feature: GYAE6OF01DF1MK.39.31.C09.1.454.CMB.1.raw
  modified_base (490)..(491): a, c, t, g, unknown or other
  misc_feature (490)..(491): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaaccaggacagcctcctaaagttgctcatttactgggcatctacccgggagtccggggtccctgaccgattcagcggcagcggtctgagacagatttcactctcaccatcagcagcctgcaggctgaagatgtggcagtttattactgtcagcagtattatagtagtcctcagtacttttggccggggacagctggagatacaaacgaactgtggctgcacatctgtctnntcc

SEQ ID NO: 3220 - DNA, 541 bp, Homo sapiens
  misc_feature: GYAE6OF01B7QGD.39.31.C09.1.454.CMB.1.raw
  modified_base (290)..(290): a, c, t, g, unknown or other
  misc_feature (290)..(290): n is a, c, g, or t
  modified_base (389)..(389): a, c, t, g, unknown or other
  misc_feature (389)..(389): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagttgtttacacaggtccaacaataagaattacttcgcttggtaccagcaagaaaccaggacagcctctaagtgctcatttacnggcatccgtacccggagtccggggtccctgaccgattcagcggcaggcggtctgagacagtatttcactctcacatcagcacgctgcaggctagaagtntgtcgactagtttatactgtacagtactagttattatagtacgtcctacgtagttacgtttcgggaccggggtaaccaaggcgtaggaagtactacgaaacgtacgtgtacggtctacgacaccgtacttcgtagttcttctacgttccccg

SEQ ID NO: 3221 - DNA, 515 bp, Homo sapiens
  misc_feature: GYAE6OF01CFS4B.39.31.C09.1.454.CMB.1.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctctaagttgctcatttacnggcatctacccgggagtccggggtccctgaccgtatcagcgcagcgggtctgagacagatttcactctacaccatcagcagcctgcaggctgaagatggtggactagtttatactgtcagcagtattatagtacgtctctagtacgtttgggccggggtaacgagcgtggagaatacgaaaacgtacgtggtacggtctcgacactactctgtcttcacttcccg

SEQ ID NO: 3222 - DNA, 589 bp, Homo sapiens
  misc_feature: GYAE6OF01BKV41.39.31.C09.1.454.CMB.1.raw
  modified_base (292)..(292): a, c, t, g, unknown or other
  misc_feature (292)..(292): n is a, c, g, or t
  modified_base (343)..(343): a, c, t, g, unknown or other
  misc_feature (343)..(343): n is a, c, g, or t
tcagtcgcactagtcacgaccggtgctcgatttagacgtctcatcaaggaaggaaggggcagcaagatggtgttgcaagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctctaagttgctcatttacngggcatctaccgggagtccggggtccctgaccgattcagcggcagcggtcngagacagatttcactctcaccatcagcacgcctgcaggctagaagtactgtcgctaagttttattaacgtgtactagactagttattatagtaacgttccctagtacggttacgttttcgggcccgggggtaaccaaggtcgtagggaacgtaacgtaaccgtaaaacggtaccgttagggtcgggtaccgttaccgaccgtaaccgtacgttaccttggttacccgtttcgtaaccgttccccgg

SEQ ID NO: 3223 - DNA, 517 bp, Homo sapiens
  misc_feature: GYAE6OF01BE9SZ.39.31.C09.1.454.CMB.1.raw
  modified_base (510)..(510): a, c, t, g, unknown or other
  misc_feature (510)..(510): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagctagtattatagtagtcctctagtacgtttcgggaccggggtaccaggcgtggagtatacgaaacgtactggtggtcgtcgcaccgtatctgtcttcncttcccg

SEQ ID NO: 3224 - DNA, 506 bp, Homo sapiens
  misc_feature: GYAE6OF01D1MVI.39.31.C09.1.454.CMB.1.raw
  modified_base (430)..(430): a, c, t, g, unknown or other
  misc_feature (430)..(430): n is a, c, g, or t
  modified_base (464)..(464): a, c, t, g, unknown or other
  misc_feature (464)..(464): n is a, c, g, or t
  modified_base (499)..(499): a, c, t, g, unknown or other
  misc_feature (499)..(499): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaaccaggacagcctcctaagttgctcatttactgggcatctacccgggagtccggggtcctgaccgattcagcggcagcggtctgagacagatttcactctcaccatcagctagcctgcaggctgaagatgtggcagtttattactgtcagcagtattatagtagtcctnagtacgttttgggccggggtaccaagcgtagganatacaaacgaactgtaggctgcaccatctgtcttnattcccg

SEQ ID NO: 3225 - DNA, 639 bp, Homo sapiens
  misc_feature: GYAE6OF01DA8EZ.39.31.C09.1.454.CMB.1.raw
tcagtcgcactagtcacgaccggtgctcgatttagacgtctcatcaaggaaggaaggggcagcaagatggtgttgcaggcccaggtcttcatttctctgttgctctggatctctggtgcctacggggacatcgtgatgacccagtctccagactccctggctgtgtctcgtgggcgagagggccaccatcaactgcaagtccagccagagttgtttacacagtaccaacaataagaatttacttcgcttcggtaccagacaagaaaccaggacagcctacctaagttcgctctatttacgtgggactacgtccggtacccggggtacggtcccggggtccctagaccgtattcgaggccggcgacggcgggtctaggacgacagtactttccacttcctacaccatcgagccacggcctgcgacggctaggaaagtgttaggtacggtacgttaagttttacttacgttcgtacgtagtacgtaagtttattagttacggttaacgttccgttacggtacggttaacggtttcggggacccggggtaacaaggtcgtaggacgtacgtaacgtaaacggtacgttggtcggtcctacggacctacctacgttcgttacgttccttaccgtcttaccccg

SEQ ID NO: 3226 - DNA, 511 bp, Homo sapiens
  misc_feature: GYAE6OF01BGQHY.39.31.C09.1.454.CMB.1.raw
  modified_base (505)..(505): a, c, t, g, unknown or other
  misc_feature (505)..(505): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtcccggggtccctgaccgattcagcggcagcgggtctgagacagatttcactctcaccatcagcagcctgcaggctgaagatgtggctagtttattactgtcagcagtattatagtagtcctctagtacgtttcgggccggggaccagcgtggagagtacgaaacgacgtgtggctcgcactactctgtcttcgtnttcccg

SEQ ID NO: 3227 - DNA, 524 bp, Homo sapiens
  misc_feature: GYAE6OF01B3966.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcacatcagcagcctgcaggctagaagagtgtggctagtttattactgtcagactagtattagtagtacgtcctcgtagtacgttttcgggccggggtaccgagcgtggagtactacgaaacgaacgtaggtcggtcgcgcacctatctagtcttctcttcccg

SEQ ID NO: 3228 - DNA, 681 bp, Homo sapiens
  misc_feature: GYAE6OF01AJ7KF.39.31.C09.1.454.CMB.1.raw
tcagtcgcactagtcacgaccggtgctcgatttagacgtctcatcaaggaaggaaggggacgagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacactaggtccaacaataagaattacttcgcttggtaccagcaagaaccaggacagcctcctaagtgctactatttacgtggccataccgtacccgggagtcccggggtccctaggacccgtattccgaggccggcacggtccggggtctaggacgtaccaaggtacttttaccaaccttccgtacaccctaacttcgaaccgcgtaacgccccgttagccgaaacgggtcctagggtaaacgtagtacggttagggtaccttaaggtttttacgtttaaccgttaggtttacccaagtaccgtaagttaactttagtacgttaacgtccgttacgtagttaaccggttttcggggaacccggggtaccgaacggtccgtagggtagtacgtaacgtaaaccggtaacgtggttacggcgtacggacccaccgtacttacgtacgtttccttgtcccgttacccg

SEQ ID NO: 3229 - DNA, 522 bp, Homo sapiens
  misc_feature: GYAE6OF01C2TBP.39.31.C09.1.454.CMB.1.raw
  modified_base (295)..(295): a, c, t, g, unknown or other
  misc_feature (295)..(295): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttcgctctatttacnggcatcctaccggagtccgggtcctgaccgattcgagcggcaggtcggtctgagacagtatttcactctcaccatcagcagcctgcagcagaagagtgtggactagtttatactgtcagctagtatatacgtagtcctcgtagtacgtttcgggaccgggtaccagtcgtagagactacgaaacgtacgtgtacggctacgcaccgtactactgtcttcacttcccg

SEQ ID NO: 3230 - DNA, 601 bp, Homo sapiens
  misc_feature: GYAE6OF01EHD5C.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctctatttacgtgggcagtccgtacccggggacggtcccggggtccctggaccgattcgacgtcggcaggcgggtctgagacagtactttcactctcaccatcagcagcctgcaggcagaagatgtgactagtttatactgtacagtctaagttaattagtagtacgtccttacgtagttaccgttttacggggacccgggggtaaccctaaggtaccgtagggaacgtacgtaaccgtaaaacggtaacgttagggtacgggtcttaccggcctaacccgtacttaccgttagttacctttcgtaccgtttaccccg

SEQ ID NO: 3231 - DNA, 547 bp, Homo sapiens
  misc_feature: GYAE6OF01D52YA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcaagaaaccaggacagcctactaagttgctcatttactgggcatccgtacccgggagtccggggtccctgaccgattcgagcggcaggcgggtctgagacagtatttcactctcaccatcagcagcctgcaggctagaagagtgtggctagtttattactgtcagtactagttattagtagtacgttacctacgtagttacgttttcgggaccggggtaacgaggcgtaggagtacgtaacgaaacgtaacgtagtcggctacgacacctactctacgttcttctcttcccg

SEQ ID NO: 3232 - DNA, 597 bp, Homo sapiens
  misc_feature: GYAE6OF01EBR9X.39.31.C09.1.454.CMB.1.raw
  modified_base (296)..(296): a, c, t, g, unknown or other
  misc_feature (296)..(296): n is a, c, g, or t
  modified_base (406)..(406): a, c, t, g, unknown or other
  misc_feature (406)..(406): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctacctaagttgctctatttacgngggcagtccgtacccggggagtcccggggtccctgaccgtattcgaggcggcacggcgggtctggagacagtatttcactctcaccatcagcagcctgcaggctagaagntgtagtcgtagtttacttacgtgtacgagtacgtagttaattaagttacgttacgttaccgttactaacggtttaccggttttacggggacccgggggtaacaacgggtcgtaggaacgtacgtaaccgaaaacggtacgttaggtacggtctacgccaacgtacttcgtacgttcttcgtacgttccccg

SEQ ID NO: 3233 - DNA, 686 bp, Homo sapiens
  misc_feature: GYAE6OF01BX5ZG.39.31.C09.1.454.CMB.1.raw
  modified_base (443)..(443): a, c, t, g, unknown or other
  misc_feature (443)..(443): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgcaagtccagccagagtgtttacacaggtaccaacaataagaattacttcgcttggtaccagacagaaaccaggacacgcctacctaagttgctataatttactgggactactccgtacccgggacggtcccggggtccctggacccgtattccgaaggccggacgacggtccggggttctaggaagaaccgagtacttttccgaacttcctacaacccatcagcacgcctgccaggctaggaaagngtggtacggacttaaggttttattacgttgtccgaagtaccgtaagttaatttaagttaggttaccgttacccgtacggtaacggttaccggttttaccgggggacccgggggtaaacctaagggtccgtagggtaagaaccgttaaaccgaaaaccgggtaacttgggttaaccgggccttaacggtacccgaacccgtactttccgttacggtttaccttacccgttactttaccccccgg

SEQ ID NO: 3234 - DNA, 500 bp, Homo sapiens
  misc_feature: GYAE6OF01ENHVF.39.31.C09.1.454.CMB.1.raw
  modified_base (291)..(291): a, c, t, g, unknown or other
  misc_feature (291)..(291): n is a, c, g, or t
  modified_base (490)..(490): a, c, t, g, unknown or other
  misc_feature (490)..(490): n is a, c, g, or t
  modified_base (496)..(496): a, c, t, g, unknown or other
  misc_feature (496)..(496): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagtgctcatttacnggcatctacccgggagtccgggtccctgaccgattcagcggcagcggtctgagacagatttcactctcaccatcagcagcctgcaggctgaagatgtgctagtttattactgtcagcagtattatagtagtcctctagtacgtttcgggaccgggacacgcgtggacgagtacaacgactgtaggctagacactatctntctctntccc

SEQ ID NO: 3235 - DNA, 538 bp, Homo sapiens
  misc_feature: GYAE6OF01AJ3D3.39.31.C09.1.454.CMB.1.raw
  modified_base (529)..(529): a, c, t, g, unknown or other
  misc_feature (529)..(529): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcctacccgggagtcccggggtccctgaccgattcagcggcaggcgggtctgagacagattttcactctcaccatcagcacgcctgcaggctagaagatgtggctagtttattactgtcagctagttattatagtagtcctactagttacgttttgggcccggggtacctaaggcgtaggagtagtacgaaaccgtaacgtggtaggctacgccacctattctagttccttntcttccccg

SEQ ID NO: 3236 - DNA, 608 bp, Homo sapiens
  misc_feature: GYAE6OF01A21ZL.39.31.C09.1.454.CMB.1.raw
tcagtcgcactagtcacgaccggtgctcgatttagacgtctcatcaaggaaggaaggggcagcaagatggtgttgcagacccaggtcttcatttctctcttgctctggatctctgttgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgcctctatttacgtggcactccgtacccgggacggtcccggggtccctacgaccgtacttcacggcgcaggcggtctggacgacagtactttccactctcaccatcgagcacgcctcgacgacggtctaggaagtagtggtacggtacgttagttttaacttacgttcgtacgagtacgtaagtttaattaagttagttacgttacctacgtaacgtttacggttttacggggacccggggtaaccgtacggtcgtaggagtactaaccgaaacgtacgtggtacggtcgtacgacacgtacttcgttacttcttctacgttccccg

SEQ ID NO: 3237 - DNA, 654 bp, Homo sapiens
  misc_feature: GYAE6OF01BFBB1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaaacaataagaattacttcgcttggtaccagcaagaaaccaggacagcctactaagttcgctctatttacgtgggctagtccgtacccgggtacggtcccggggtcctacgaccgtattcgacggccggcgacggccgggtactaggacgaacgagtacttttccgacttccgtaccacctactacgacgcacgtccgtcgacgacggtcgtagaagtagtacggtcggtacttacggttttaattacgttgtaccgtagtacgtaagttaatttacgtaacggttacgttacccgttacgtacgtttaccggttttcggggacccggggtaacgacggtacgtagggagtaacgtaaccgtaaacggtacgtggtacggtacgtcgaccacgttacttaccgttcgtttacttccgtcgttaccccg

SEQ ID NO: 3238 - DNA, 518 bp, Homo sapiens
  misc_feature: GYAE6OF01CAESB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccgggagtcccggggtcctgaccgattcagcggcagcgggtctgagacagatttcactctcaccatcagcagcctgcaggctgaagatgtggctagtttattactgtcagcagtattatagtagtcctcagtacgttttcgggccggggtaaccagtcgtaggagtactacgaaacgaacgttgtacggctcgcaccgtatctgttcttcattccccg

SEQ ID NO: 3239 - DNA, 531 bp, Homo sapiens
  misc_feature: GYAE6OF01BRS4G.39.31.C09.1.454.CMB.1.raw
  modified_base (289)..(289): a, c, t, g, unknown or other
  misc_feature (289)..(289): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctctaagtgctcatttacngggcatcctacccgggagtccggggtcctgaccgattcagcggcgagcgggtctgagacagatttcactctcaccatcagcagcctgcagctagaagtagtgtgctagttatactgtcagcagttattatagtcgtactcgtagtacgttttcgggacccggggtactaggcgtaggagtacgtaacgaaaccgtacgtaggtggtcctacgactaccgtatctagtcttccgtattccccg

SEQ ID NO: 3240 - DNA, 550 bp, Homo sapiens
  misc_feature: GYAE6OF01BPOAA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctacctaagttgctcatttactgggcatccgtacccgggagtcccggggtccctgaccgattcgagcggcaggcggtctgagacagatttcactctcaccatcagcagcctgcgaggctagaagatgtggactagtttattactgtcagctagttattatagtatcctagagtcgtttcgggccgggtacagcgtaggagtacgtaacgaaacgtacgttggtacggtccgtacgaccctaaccgtacgttccttacgttcctttcgtacgtttaccccg

SEQ ID NO: 3241 - DNA, 693 bp, Homo sapiens
  misc_feature: GYAE6OF01BI95P.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcactccggaccggtacgggtcccggtcgcgacgtctcgacggccgagcggtcggtgtagacgacgagttacttactactctaccacctactacgacgtacgaccgtccgtcgacggacggtcgtaaggaaacgtaggtacggtacggtaacgtttaacgtttttaacgttacgttacgtacgtacgtacgttaagtttaagtttaagttaagttacccgttaccgttacgtaacggtttttaccgggtttacccggggggtaacccggggtaaccgaacggttacggtaagggtaacgtaaccgtaaaaccgtaaaaccggtacggttagggtacggttccgtaccgtacccgtaaccgttacttacgtttaccttcctttacgttccgtttaccccccg

SEQ ID NO: 3242 - DNA, 510 bp, Homo sapiens
  misc_feature: GYAE6OF01BC2QQ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagtgctcatttactgggcatctacccgggagtccgggtcctgaccgattcagcggcagcgggtctgagacagatttcactctcaccatcagcagcctgcaggctgaagatgtggctagtttattactgtcagctagttattatagtagtcctcagtacgtttcgggaccggggacagcgtggagagtacgaaacgactaggtcggctcgacacctactctatctcgtcttcccg

SEQ ID NO: 3243 - DNA, 507 bp, Homo sapiens
  misc_feature: GYAE6OF01A7IR3.39.31.C09.1.454.CMB.1.raw
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagctagtattatagtagtcctcagtacgttttcgggaccggggtaccagcgtggagatacgaaacgtactggtggctgcactatctntcttcntccc

SEQ ID NO: 3244 - DNA, 586 bp, Homo sapiens
  misc_feature: GYAE6OF01EFLIX.39.31.C09.1.454.CMB.1.raw
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgctctatttacngggcatcgtacccgggagtccggggtcctggaccgattcagcggcaggcgggtcngagacagatttcactctcaccatcagcacgcctgcgaggctagaagagtgtggctagtttattacgtgtctagctaagttattattagttacgtacctactagttaccgttttacggggacccgggggtaaccgaacggtcgtagggaacgtaagtaaccgaaaacggtaaccgtgggttacggtcgtacggtacccaaccgtacttaccgttgtttcccttcgtaacctttccccg

SEQ ID NO: 3245 - DNA, 501 bp, Homo sapiens
  misc_feature: GYAE6OF01CAYM1.39.31.C09.1.454.CMB.1.raw
  modified_base (431)..(431): a, c, t, g, unknown or other
  misc_feature (431)..(431): n is a, c, g, or t
  modified_base (494)..(494): a, c, t, g, unknown or other
  misc_feature (494)..(494): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagtagaaaccaggacagcctcctaagttgctcatttactgggcatctacccgggagtccggggtccctgaccgattcagcggcagcggtctgagcagatttcactctcaccatcagcagccctgcaggctgaagatgtggctagtttattactgtcagctagtattatagtagtcctnagtacgtttggccggggacaagctaggagatacaaacgtacgtgtgctgcacatctgtcttcntctcccg

SEQ ID NO: 3246 - DNA, 550 bp, Homo sapiens
  misc_feature: GYAE6OF01BC5D8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccgggagtccggggtccctgaccgattcgagcggcagcggtctgagacagatttcactctcaccatcagcacgcctgcaggctagaagatgtggctagtttattactgtcagctagttatttaagtagttacgttccctgtacgtacgttttcgggacccgggggacctaacggctagggagtactaaccgaaaacgtaacgttggtaggtcgtacgcctaacctacttctagttccttctcttccccg

SEQ ID NO: 3247 - DNA, 514 bp, Homo sapiens
  misc_feature: GYAE6OF01B26R0.39.31.C09.1.454.CMB.1.raw
  modified_base (501)..(501): a, c, t, g, unknown or other
  misc_feature (501)..(501): n is a, c, g, or t
tcagtcgcactagtcacgaccggtgctcgatttagacgtctcatcaaggaaggaaggggcagcaagatggtgttgcagacccaggtcttcatttctctcttgctctggatctctggtgcctacggggacatcgtgatgacccagtctccagactcccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtcccggggtccctgaccgattcagcggcagcggtctgagacagtatttcactctcaccatcagcagcctgcaggctgaagatgtggctagtttatactgtcagctagtattatagtagtcctagtacgtacgttttcgggccggggtaccagcgtaggagatacgaaacgacgtgtggctgcactatcgtntcttcgcttcccg

SEQ ID NO: 3248 - DNA, 506 bp, Homo sapiens
  misc_feature: GYAE6OF01CVFI9.39.31.C09.1.454.CMB.1.raw
  modified_base (501)..(501): a, c, t, g, unknown or other
  misc_feature (501)..(501): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctagaagatgtggctagtttattactgtcagcagtattatagtagtcctcagtacttttgggccggggtaccagcgtggagatacgaaacgaacgtgtggctcgcacctactctgtcttcnttccc

SEQ ID NO: 3249 - DNA, 544 bp, Homo sapiens
  misc_feature: GYAE6OF01ASSB8.39.31.C09.1.454.CMB.1.raw
  modified_base (396)..(396): a, c, t, g, unknown or other
  misc_feature (396)..(396): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcaagaaaccaggacagcctcctaagttgctcatttactggcatccgtacccgggaggtcccggggtccctgaccgattcagccggcaggcgggtctggagacagtatttcactctcaccatcagcagcctgcaggctagaagntgtggactagtttactactgtcagctaagttattatagtagtcctacgtagttacgtttcgggaccgggtaacagtcgtaggagtacgtaaccgaaacgtacgtggtggtctggaccaccgtactcgttacgttcttctcgttccccg

SEQ ID NO: 3250 - DNA, 550 bp, Homo sapiens
  misc_feature: GYAE6OF01CV0E5.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataaagaattaacttcgcttggtaccagcagaaaccaggacagcctcctaaagttgctcatttactgggcatcctacccgggagtccggggtccctgaccgattcagcggcagcgggtctgagacagtatttcactctcacatcagcagcctgcaggctagaagatgtggactagtttatacgtgtcagctaagtattaagttagtaacgtccttactagtaccgttttggggcccggggaaccgacgacgtggtagactacgaaaacggtaactaggtcggtcgtacgccaacctactcttgtcttccgtacttccccg

SEQ ID NO: 3251 - DNA, 605 bp, Homo sapiens
  misc_feature: GYAE6OF01DI2MD.39.31.C09.1.454.CMB.1.raw
  modified_base (302)..(302): a, c, t, g, unknown or other
  misc_feature (302)..(302): n is a, c, g, or t
  modified_base (482)..(482): a, c, t, g, unknown or other
  misc_feature (482)..(482): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgtttacacaggtaccaacaaataagaattacttcgcttggtaccagcaagaaaaccaggaacacgcctacctaagttgcctactactttacgngggcactccgtacccggggacggtcccggggtccctggacccgtattcgacggcggcacggcgggtctgagacagtatttcactctacaccatcagtcacgcctgccgaggctaggaaagtagtggtacggacttaagtttacttacgtgtcagtactaagttattatagtcgttacctntaggttacgtttcggggaccggggtaacctaaggtccgtaggaacgaactaaccgaaaacggtaccttgggtacggtcgtcgaccaacccgtagttacctggtttccttcgtacgtttccccg

SEQ ID NO: 3252 - DNA, 501 bp, Homo sapiens
  misc_feature: GYAE6OF01DVS65.39.31.C09.1.454.CMB.1.raw
  modified_base (393)..(393): a, c, t, g, unknown or other
  misc_feature (393)..(393): n is a, c, g, or t
  modified_base (496)..(496): a, c, t, g, unknown or other
  misc_feature (496)..(496): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccgggagtccgggtccctgaccgattcagcggcagcgggtctgagacagatttcactctcaccatcagcagcctgcaggctgaagatgtggntagtttattactgtcagcatattatagtagtctctagtactttgggccggggaccaagcgtaggagatacgaaacgactgtggctgcacctatctagtcttcnttccc

SEQ ID NO: 3253 - DNA, 509 bp, Homo sapiens
  misc_feature: GYAE6OF01BNH4V.39.31.C09.1.454.CMB.1.raw
  modified_base (291)..(291): a, c, t, g, unknown or other
  misc_feature (291)..(291): n is a, c, g, or t
  modified_base (504)..(504): a, c, t, g, unknown or other
  misc_feature (504)..(504): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttacngggcatcctacccgggagtcccggggtccctgaccgattcagcggcagcgggtctgagacagatttcactctcaccatcagcagcctgcaggctagaagatgtggctagtttattactgtcagctagttattatagtagtcctctagtacgttttgggccggggtaccagcgtggagatacaaacgacgtgtggctgcacctatctgtcttcnttccc

SEQ ID NO: 3254 - DNA, 536 bp, Homo sapiens
  misc_feature: GYAE6OF01B6FE2.39.31.C09.1.454.CMB.1.raw
  modified_base (322)..(322): a, c, t, g, unknown or other
  misc_feature (322)..(322): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtccaacaataagaattacttcgcttggtaccagcaagaaaccaggacagcctacctaagttgctcatttactggcatcctacccgggagtccggggtccngaccgattcagcgcagcggtctgagacagtatttcactctcacatcagcagcctgcaggctagaatagtgtggctagtttatactgtcagctagttattagttagtacgtcctcgtagtacgttttcgggaccggggaacctaggcgtagggagtactacgaaacgtacgtggtacggcgtcgacaccgtatccttgttccttcgacttccccg

SEQ ID NO: 3255 - DNA, 576 bp, Homo sapiens
  misc_feature: GYAE6OF01ASIZF.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctctgggcgaggagggccaccatcaactgcaagtccagccagagttgtttacacaggtccaaacaataagaattacttcgcttggtaccagcaagaaaccaggacagcctacctaagttgctcatttacgtgggcatccgtacccgggaggtcccggggtccctggacccgtattcagcggcaggtccgggtctggagacagtatttcactctcaccatcagcacgcctgcgaggctagaagatggtggcttagtttattacgtgtcgagctagtattatagtacgtacctcgagttacgtttcgggacccgggtactaacggcgtaggagtaacgtaccgaaaacgtacgtggtacggtccgtcgaccaaccgtacttacgttcggttaccttcgtacttacccccg

SEQ ID NO: 3256 - DNA, 667 bp, Homo sapiens
  misc_feature: GYAE6OF01C86RW.39.31.C09.1.454.CMB.1.raw
  modified_base (332)..(332): a, c, t, g, unknown or other
  misc_feature (332)..(332): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggaggccgaccagtcaactgcaagtccagccagagtgttttacacaggtccaacaataaagaattacttcgcttggtaccagcagaaaccaggacagcctcctaagttgctcatttactggcatctacccggagtccggggtccctgaccgattcngacggcagcggtctgagacagatttcaactctacacctatccaagcacgccctgaccgaggactaggaaagtagttaggtacggtactagttttacttaaccgttggttacacggtactaagttatttaagttacggttaacgttacccgttaccgtaagggttacccggtttttaggggacccgggggtaaccctaagggtaccgttaagggaacggtaacggtaacccgtaaaaaccgggtaaaccgttagggttacgggtaccgttaccgggacctaaaccccgtacgttaacccgtttacgttacccgtttccgtaacccttttcccccgg

SEQ ID NO: 3257 - DNA, 522 bp, Homo sapiens
  misc_feature: GYAE6OF01D246N.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctctatttactgggcatcctacccgggagtcccggggtccctgaccgattcagcggcagcgggtctgagacagatttcactctcaccatcagcagcctgcaggctgaagatgtggctagtttattactgtcagcagttattatagtagtcctcagtacgttttgggaccggggtaccaagtcgtaggacgatacgaaacgtacgtaggtggctgccacctactctgtcttctacttcccg

SEQ ID NO: 3258 - DNA, 518 bp, Homo sapiens
  misc_feature: GYAE6OF01EJL7N.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatccgtacccgggagtccggggtccctgaccgattcagcggcaggcggtctgagacagatttcactctcaccatcagcagcctgcaggctgaagatgtggctagtttattactgtcagctagttattatagtagtcctacgagtacgttttcgggccggggtaccaaggcgtaggagactacaaacgtacgtggtggctcgcacctatctagtcttctctccc

SEQ ID NO: 3259 - DNA, 532 bp, Homo sapiens
  misc_feature: GYAE6OF01D5UG6.39.31.C09.1.454.CMB.1.raw
  modified_base (391)..(391): a, c, t, g, unknown or other
  misc_feature (391)..(391): n is a, c, g, or t
  modified_base (523)..(523): a, c, t, g, unknown or other
  misc_feature (523)..(523): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgttttacacaggtccaacaataagaattacttcgcttggtaccagcagaaaccaggacagcctcctaagttgctcatttactgggcatctacccggggagtccggggtcctgaccgattcagcgcaggcggtctgagacagtatttcactctcaccatcagcagcctgcaggctagagatgnggctagtttattacgtgtcagctagttattatagttacgtcctacgaggttaccgttttcgggcccggggtaaccaaggtcgtaggagactacgaaacggactaggtagctcgacaccgtattctgttcttntcttccccg

SEQ ID NO: 3260 - DNA, 514 bp, Homo sapiens
  misc_feature: GYAE6OF01CUGI2.39.31.C09.1.454.CMB.1.raw
  modified_base (290)..(290): a, c, t, g, unknown or other
  misc_feature (290)..(290): n is a, c, g, or t
  modified_base (427)..(427): a, c, t, g, unknown or other
  misc_feature (427)..(427): n is a, c, g, or t
  modified_base (465)..(465): a, c, t, g, unknown or other
  misc_feature (465)..(465): n is a, c, g, or t
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttgtaccagcagaaaccaggacagcctcctaagttgctcatttacnggcatcgtacccgggagtcccggggtccctgaccgattcagcggcagcgggtctgagacagtatttcactctcaccatcagcagcctgcaggctagaagagtgtggctagtttatactgtcagtcagtattatagtntcctacgagtacgtttgggaccggggacaggcgtgganagtacaaacgtacgtgtggctcgacacctattctntccttnacttcccg

SEQ ID NO: 3261 - DNA, 520 bp, Homo sapiens
  misc_feature: GYAE6OF01BS1TS.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccctggctgtgtctctgggcgagagggccaccatcaactgcaagtccagccagagtgtttacacaggtccaacaataagaattacttcgcttggtaccagcagaaaccaggacagcctcctaagttgctcatttacngggcatctacccgggagtccggggtccctgaccgattcgagcggcaggcgggtctgagacagtatttcactctcaccatcagcagcctgcaggctagaagatgtgactagtttattactgtcagctagtattatagtacgtcctcgagtacgtttcgggccggggtacagcgtaggagtacgtacgaaacgacgtgtaggctgcacctatctgttcttctcgttcccg

SEQ ID NO: 3262 - DNA, 498 bp, Homo sapiens
  misc_feature: GYAE6OF01CRBVW.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaaccaggacagcctcctaagttcgctcatttactgggcatctacccggagtccggggtcctgaccgatcagcggcagcggtctgagacagatttcactctcaccatcagcagcctgcaggctgaagatgtgctagtttattactgtcagcagtattatagtatctcgagtacgtttggaccgggtacagctggagatacaaacgtactagtgctgcactatctagtcttctcttccc

SEQ ID NO: 3263 - DNA, 669 bp, Homo sapiens
  misc_feature: GYAE6OF01AXDMV.39.31.C09.1.454.CMB.1.raw
  modified_base (189)..(189): a, c, t, g, unknown or other
  misc_feature (189)..(189): n is a, c, g, or t
  modified_base (263)..(263): a, c, t, g, unknown or other
  misc_feature (263)..(263): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (441)..(441): a, c, t, g, unknown or other
  misc_feature (441)..(441): n is a, c, g, or t
  modified_base (487)..(487): a, c, t, g, unknown or other
  misc_feature (487)..(487): n is a, c, g, or t
  modified_base (531)..(531): a, c, t, g, unknown or other
  misc_feature (531)..(531): n is a, c, g, or t
  modified_base (566)..(566): a, c, t, g, unknown or other
  misc_feature (566)..(566): n is a, c, g, or t
  modified_base (595)..(595): a, c, t, g, unknown or other
  misc_feature (595)..(595): n is a, c, g, or t
  modified_base (639)..(639): a, c, t, g, unknown or other
  misc_feature (639)..(639): n is a, c, g, or t
  modified_base (646)..(646): a, c, t, g, unknown or other
  misc_feature (646)..(646): n is a, c, g, or t
  modified_base (664)..(664): a, c, t, g, unknown or other
  misc_feature (664)..(664): n is a, c, g, or t
tcagtcgcactagtcacgaccggtgctcgatttagacgtctcatcaaggaaggaagggcgagcaagatggtgttgcagaccaggtcttcattctctgttgctctggatctctggtgcctaacgggacatcgtgatgacccagtcctccagacctcccgtggctagtgtctcgtgggacgagaggccacntcaactgacaacgtccagccaggagttcgttttacacgaggtaccaaaacaaagtaggtaaactttaccgttcnccggttttaggtaaccctaggaaccaaggtaaacccaaggtacaacgccttaccgtaagttcgactactacgtttacgngggtacncttaccggtaccgggaacgtttcccgggggtaccctggtacccgtatacgtaccgtacgggcacgggttccgggtactggtaacaaacccgnggtacttttacccgacgtctacacccgaattcgaacgcttaccggntcggactacggtatacggactaagtgtcgagtagtttctaagtnaccgttagcttaggtaactagtttgaagttacccngtacgttacgttccggaccgggtacgtanacggtggtactaagtaacgtaaacggccttaggacggtcacgtntaaccgngtaccttagtccgttacncgtcc

SEQ ID NO: 3264 - DNA, 554 bp, Homo sapiens
  misc_feature: GYAE6OF01DYJMP.39.31.C09.1.454.CMB.1.raw
  modified_base (348)..(348): a, c, t, g, unknown or other
  misc_feature (348)..(348): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctctatttactgggcatccgtacccgggaggtccggggtccctgaccgattcagcggcaggcgggtntgagacagatttcactctcaccatcagcagcctgcaggctagaagatggtgactagtttatactgtacagtctagtattatagtacgtcctacgtacggttacgttttacggggcccggggtaacacggtcgtagggacgtaacgtacgaaacgtaaccgtggtcggtctcgacaccctatacgttagttccttcgtgttaccccg

SEQ ID NO: 3265 - DNA, 568 bp, Homo sapiens
  misc_feature: GYAE6OF01CA534.39.31.C09.1.454.CMB.1.raw
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacnggcatctacccgggagtccgggtcctgaccgattcagcggcaggcggtctgagacagtntttcactctcaccatcagcagcctgcgaggctagaagatgtggactagtttattacgtgtcagtctaagttattaagtagttacgtacctacgtacgttacgttttacggggaccggggtaacctaaggccgtagggaagtactacgaaaaccggtaacgttaggtacgggtctacgtcccaaccgtacttaccttacggttccttcgtacttccccg

SEQ ID NO: 3266 - DNA, 556 bp, Homo sapiens
  misc_feature: GYAE6OF01C1RFY.39.31.C09.1.454.CMB.1.raw
  modified_base (297)..(297): a, c, t, g, unknown or other
  misc_feature (297)..(297): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaacaataagaattacttcgcttggtaccagcagaaaccaggacagcctacctaagttcgctactatttacgngggcagtccgtacccgggacgtccggggtccctggaccgtattcagcggcaggccggtctgagacagtatttcactctacacctatcacgcacgcctgcgaggctagaagagtggtggtacgtagtttattacgtgtcagctagtattatagtagtcctgacgtacgtttcgggccgggtacagcgtaggagtacgtaacgaaacgtacgtaggtcggcgtacgacctaacctattacctagttccttcgtacttcccg

SEQ ID NO: 3267 - DNA, 560 bp, Homo sapiens
  misc_feature: GYAE6OF01AOP04.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacagcctacctaagttgctcatttacgtgggcatccgtacccggggacgtcccggggtccctggaccgtattcagcggcaggcgggtctgagacagtactttcactctcaccatcagcagcctgcaggctagaagagtggtggactagtttatactgtacagctagttattatagtagtcctagtacgttacgtttcgggaccgggtaccgaggcgtaggagtacgtaaccgaaacggtacgtaggtacggtctacgaccacctaattccgttagttccttcctacgttccccg

SEQ ID NO: 3268 - DNA, 523 bp, Homo sapiens
  misc_feature: GYAE6OF01BPOVY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctcatttactgggcatcgtacccgggagtcccggggtccctgaccgattcagcggcaggcgggtctgagacagtatttcactctcaccatcagcagcctgcaggctagaagatgtggactagtttattactgtcagctagttattatagtagtcctacgtagtacgttttcgggaccggggtacacgcgtggagatacgaaacgacgtgtggctcgacacctatctgtcttcgcttcccg

SEQ ID NO: 3269 - DNA, 498 bp, Homo sapiens
  misc_feature: GYAE6OF01C7BP3.39.31.C09.1.454.CMB.1.raw
  modified_base (427)..(427): a, c, t, g, unknown or other
  misc_feature (427)..(427): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctatgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtcctgaccgattcagcggcagcggtctgagacagatttcactctcaccatcagcagcctgcaggctgaagatgtggctagtttatactgtcagcagtattatagtagtcctnagtactttggaccgggacagctaggagatacaaacgaactgtggctgcactactctagtcttntnttcccg

SEQ ID NO: 3270 - DNA, 613 bp, Homo sapiens
  misc_feature: GYAE6OF01B2USN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaacaataagaattacttcgcttggtaccagcagaaaccaggacagcctcctaagttgctctatttacgtgggacagtccgtacccggggagtcccggggtccctgaccgtattcgaggcggcgacgcgggtctggacgacagtactttccaactcctacaccatcgagcacgcctggcacggtctaggaactagtggtcggtacttaagtttacttaacgtgtactagacgtaagttaatttaagtagttacgtccttacgtacggtttaccggttttcggggacccggggtaacctaacggtcgtaagggagtaacgtaaccgaaacgtacgttggtacggcttacgaccctaccgtattccgttagttccttccgtaacttccccg

SEQ ID NO: 3271 - DNA, 587 bp, Homo sapiens
  misc_feature: GYAE6OF01C5O5T.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagacagaaaccaggacagcctacctaagttgctctatttacgtgggcagtccgtacccgggtacgtcccggggtcctggaccgtattcagccggcaggcgggtctgacgactagtactttcactctacacctatcgagcacgtcctgcgaggctagaagtagtggtggactagtttattacgtgtacagtctagttattagtagtaacgttacctacgtacgttacgttttcgggaccggggtaaccgaggtacgtaggacgtacgtacgaaacgtacgtaggtacggtcgtacgtacctaccgtacttacgttagttccttcgtcgttaccccg

SEQ ID NO: 3272 - DNA, 502 bp, Homo sapiens
  misc_feature: GYAE6OF01C4SPL.39.31.C09.1.454.CMB.1.raw
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtcctgaccgattcagcggcagcggtctgagacagtatttcactctcaccatcagcagcctgcaggctagaagatgtggctagtttattactgtcagctagtattatagttacgtctcagttacgtttgggccgggacagcgtaggagatacgaaacgtatgtggctgcactatctntctctntcccg

SEQ ID NO: 3273 - DNA, 605 bp, Homo sapiens
  misc_feature: GYAE6OF01C3JB6.39.31.C09.1.454.CMB.1.raw
  modified_base (301)..(301): a, c, t, g, unknown or other
  misc_feature (301)..(301): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtcctccagacctccctggctgtgtctcgtgggcgagaggccacatcaactgcaagtccagccagagttgtttacacagtaccaaacaataagaattacttcgcttaggtaccagacaagaaaccaggacagcctacctaagtcgactctatttacgnggcagtccgtacccgggaggtcccgggtccctgaaccgtattcgagaccggcaggtccgggtctaggacgactagtactttacacttcacactactcagcagtcctagcaggctagaagatggtaggtacttaagtttactacgttgtacgacgtacttaagttaattaagttagtaccgtacttacgtacggttaccggtttcggggacccggggtaacgacgtcgtagggaagtacgtaaccgaaaaccggtataggtacggtctaccgacaccgtatccgttagttcctcgtacttccccg

SEQ ID NO: 3274 - DNA, 501 bp, Homo sapiens
  misc_feature: GYAE6OF01ARDJE.39.31.C09.1.454.CMB.1.raw
  modified_base (472)..(472): a, c, t, g, unknown or other
  misc_feature (472)..(472): n is a, c, g, or t
  modified_base (493)..(493): a, c, t, g, unknown or other
  misc_feature (493)..(493): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtccctgaccgattcagcggcagcgggtctgagacagatttcactctcaccatcagcagcctgcaggctgaagatgtggctagtttatactgtcagcagtattatagtagtctcagtactttggccggggtacagcgtggatatacgaaacgacgtgnggctgcacctactctattctntcttcccg

SEQ ID NO: 3275 - DNA, 583 bp, Homo sapiens
  misc_feature: GYAE6OF01COCRI.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataaagaattacttcgcttggtaccagcagaaaccaggacagcctctaagttgctcatttacgnggcatcgtacccgggagtccggggtccctgaccgattcagcgcaggcggtctgagacagtactttcactctacacctatcagcacgcctgcaggctagaagatggtgtactagtttattactgtcagtctaagttattaagtagttacgtcctacgtacgttacgttttacggggacccggggtaacctaggtacgtaggaagtaacgtaacgtaaaaccggtaacgttggtacggtccgtacgaccctaaccgtacttaccttagttccttccgtccgtttacccccg

SEQ ID NO: 3276 - DNA, 572 bp, Homo sapiens
  misc_feature: GYAE6OF01DBLXL.39.31.C09.1.454.CMB.1.raw
  modified_base (296)..(296): a, c, t, g, unknown or other
  misc_feature (296)..(296): n is a, c, g, or t
  modified_base (389)..(389): a, c, t, g, unknown or other
  misc_feature (389)..(389): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttacacaggtaccaacaataagaattacttcgcttaggtaccagcagaaaccaggacagcctacctaagttgctctatttacgngggctatccgtacccggggagttcccggggtccctaggacccgtattcgaggcggcaggccggggtctggacgacagtatttcactctcaccntcagcagcctgcaggctgaacgatggtggactaggtttaatacgtgtacagactagtattatagtacgtccctgtaagttcgtttcgggaccggggtaacaggcgtaggatacgtaacgaaaccgacgtaggtcggacgtcgaccgtaacctacgttacgtacgtactttccgctttaccccg

SEQ ID NO: 3277 - DNA, 513 bp, Homo sapiens
  misc_feature: GYAE6OF01CBDOU.39.31.C09.1.454.CMB.1.raw
  modified_base (487)..(487): a, c, t, g, unknown or other
  misc_feature (487)..(487): n is a, c, g, or t
  modified_base (504)..(504): a, c, t, g, unknown or other
  misc_feature (504)..(504): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaaagttgctcatttactgggcatctacccgggagtccggggtccctgaccgattcagcgcagcgggtctgagacagatttcactctcaccatcagcagcctgcaggctgaagatgtggctagtttattactgtcagcagtattatagtagtctctagtacgtttggccggggacgacgcgtggagatacgaaacgtaacgtagtacggtcngcacctatactgtcttntagttcccg

SEQ ID NO: 3278 - DNA, 549 bp, Homo sapiens
  misc_feature: GYAE6OF01DIFE7.39.31.C09.1.454.CMB.1.raw
  modified_base (392)..(392): a, c, t, g, unknown or other
  misc_feature (392)..(392): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtacccagcagaaaccaggacagcctcctaagttgctcatttactgggcatcgtacccgggagtccggggtccctgaccgattcagcggcaggcggtctgagacagtatttcactctcaccatcagcagcctgcaggctgaagntggtggctagtttattacgtgtcagtcagtattatagtagtcctactagttacgttttcggggcccggggtaacaaggtcgtaggaagtacgtaccaaaacggtaacgtgggtcggtctagccaacctacttcgtacgttcttccgtacgttccccg

SEQ ID NO: 3279 - DNA, 538 bp, Homo sapiens
  misc_feature: GYAE6OF01D6Z67.39.31.C09.1.454.CMB.1.raw
  modified_base (390)..(390): a, c, t, g, unknown or other
  misc_feature (390)..(390): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctctatttactgggcatcgtacccgggagtcccgggtccctgaccgattcagcggcagcggtctgagacagatttcactctcaccatcagcagcctgcaggctgaagntgtggtctagtttattactgtcagtctagttattatagtacgtcctacgtagttacgttttcgggaccggggtacaggtcgtaggagtataacgaaacgtacgtggtcggctacgccaacccgtattacgtgttccttcgcttccccg

SEQ ID NO: 3280 - DNA, 577 bp, Homo sapiens
  misc_feature: GYAE6OF01BAA7S.39.31.C09.1.454.CMB.1.raw
  modified_base (291)..(291): a, c, t, g, unknown or other
  misc_feature (291)..(291): n is a, c, g, or t
  modified_base (367)..(367): a, c, t, g, unknown or other
  misc_feature (367)..(367): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcaagaaaccaggacagcctctaagtgctcatttacngggcatccgtacccgggagtcccgggtcctcgaccgtattcgagcggctaggcgggtctgagacagtattcactcncacatcagcagctgcaggctagaagtatggtggactagtttatacgtgtacagactagttattagtagtacgtcctagtacgttaccggtttggggacccgggtaactaggcgttagggaacgtacgtaaaccgaaaacgtaccgttaggtacggccgttacgcccgttaaacctctttaccgtagtttcccttaccgtcgtttaccccg

SEQ ID NO: 3281 - DNA, 519 bp, Homo sapiens
  misc_feature: GYAE6OF01DCCK4.39.31.C09.1.454.CMB.1.raw
  modified_base (415)..(415): a, c, t, g, unknown or other
  misc_feature (415)..(415): n is a, c, g, or t
  modified_base (492)..(492): a, c, t, g, unknown or other
  misc_feature (492)..(492): n is a, c, g, or t
  modified_base (513)..(513): a, c, t, g, unknown or other
  misc_feature (513)..(513): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaaccagcagaaaccaggacagcctcctaagttgctcatttactggcatctacccgggagtccgggtcctgaccgattcagcggcagcggtctgagacagtatttcactctcactatcagcacgcctgcaggctagaagatggtgactagtttattacgtgtacanactagtattaagtagttatcctacgtagtacgtttcggggccgggtaaccaggcgtaggagatacgaaacgaactgnggtcacgcactatctgtctcnttaccc

SEQ ID NO: 3282 - DNA, 520 bp, Homo sapiens
  misc_feature: GYAE6OF01APPGX.39.31.C09.1.454.CMB.1.raw
  modified_base (513)..(513): a, c, t, g, unknown or other
  misc_feature (513)..(513): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtccctgaccgattcagcggcagcgggtctgagacagatttcactctcaccatcagcagcctgcaggctgaagatgtggctagtttatactgtcagcagtattagtagtagtcctagtagtacgtttgggaccggggtaccaggcgtggagtactacgaaacgtactggtcggctgaccacctactctagttcttcctnttccccg

SEQ ID NO: 3283 - DNA, 518 bp, Homo sapiens
  misc_feature: GYAE6OF01A3968.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtcccggggtccctgaccgattcagcggcaggcgggtctgagacagatttcactctcaccatcagcagcctgcaggctgaagatgtggctagtttattactgtcagctagtattatagtagtcctcgagtacgtttcgggccggggtacaggcgtggagacgtacaaacgtactggtggctacgcacctatcgtagtcttctattccccg

SEQ ID NO: 3284 - DNA, 528 bp, Homo sapiens
  misc_feature: GYAE6OF01DHFKP.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactggcatctacccgggagtccggggtccctggaccgattcagcggcagcgggtctgagacagatttcactctcaccatcagcagcctgcaggctgaagatgtaggctagtttatactgtcagtctagttattatagttaagtcctacagtacgtttggaccgggggtaccagcgtaggagactacgaaacgtaacgtggttggctagccaacctattcctgttccttcgtacttccccg

SEQ ID NO: 3285 - DNA, 555 bp, Homo sapiens
  misc_feature: GYAE6OF01B1CPX.39.31.C09.1.454.CMB.1.raw
  modified_base (365)..(365): a, c, t, g, unknown or other
  misc_feature (365)..(365): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcaagaaaccaggacagcctcctaagttgctcatttactggcatcctacccgggagtcccgggtcctgaccgattcgagcggcagcgggtctgagacagtatttcactcncaccatcagcagcctgcaggctagaacgatgtggctagtttattactgtacagtctaagttattatagtagtcctacgagttacgtttcgggaccggggtaccagcgtaggagtacgtaaccgaaacgtacgtaggtcggtccgtacgacctaaccgtacgttacttacgttccttacgtctttaccccg

SEQ ID NO: 3286 - DNA, 573 bp, Homo sapiens
  misc_feature: GYAE6OF01BF31Z.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctctaagttgctcatttactggcatccgtacccgggagtccggggtccctgaccgattcgagcggcacgcgggtctgagacagtactttcactctcacatcagcagcctgcgacggctacgaagatggtcgtacttagttttaacttacgtgtacagtactaagttaacttaagtacgtacgttcctactacggttacgtttcgggaccggggtacaaggtccgtaggacgtactaacgaaaacgtacgttagtcggtctacgacctaacgtacgttactacgttcttccgtattaccccg

SEQ ID NO: 3287 - DNA, 529 bp, Homo sapiens
  misc_feature: GYAE6OF01AP1WE.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagtgctcatttacnggcatctacccgggagtccggggtccctgaccgattcagcggcagcggtctgagacagatttcactctcaccatcagcagcctgcaggctgaagatgtgactagtttattactgtcagctagtattagtagtagtcctactagtacgttttcgggaccggggtaaccaggcgtaggagtaactacgaaacgtacgttggacggtctcgaccacgtacttcgtagtcttcagttccccg

SEQ ID NO: 3288 - DNA, 581 bp, Homo sapiens
  misc_feature: GYAE6OF01BM2KT.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacagcctcctaagttgctcatttacgngggcatccgtacccggggagtcccggggtccctgaccgattcagcggcaggcgggtctgagacagtatttcactctcaccatcagcagcctgcaggctagaagagtgtggtactagtttattacgtgtcagctaagttattagtagttacgttcctactaacgttacggttttcggggacccgggggtaaccacggtcgtaggaagtaactaaccgaaaccggtaacgtggtacggtccgtacgtacctaacctattcccgttacgttccttaccgtacgttcccccg

SEQ ID NO: 3289 - DNA, 549 bp, Homo sapiens
  misc_feature: GYAE6OF01CJYEM.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacgaataagaattacttcgcttggtaccagcagaaaccaggacagcctcctaagttgctcatttacgnggcatcgtacccgggagtccggggtccctgaccgattcagcggcaggcggtctgagacagtatttcactctcaccatcagcacgcctgcaggctagaagatgtggactagtttatactgtacagctagtattagtagtacgtcctacgtagttacgtttcggggacccggggtaactaggcgtaggaacgtactaacgaaacggtacgtggtacggctacgaccaccgtacttcgttgttccttctcgttccccg

SEQ ID NO: 3290 - DNA, 836 bp, Homo sapiens
  misc_feature: GYAE6OF01DR30Q.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagaggccacatcaactgacaagtccagccagtagttgtttacacgacggtaccaaacaaataaagaatttacttcgtcttaggtaccagacaacgaaaccaggacacgcctactaagttcgactactactttacgtcgggactacgtccggtacccggggtacggttccccggggtaccctacggtaacccggtattccggaggccggacgagggtccgggtctaggaacgaaccgagttactttccgaaccttccaccaacctataccgacgtaccgacgtcccgtggccgtaaggggtacctaagggaaaggtagttacgggttacgggtaccgttttaaggttttaaccgtttaaccggttggttaaccgtaagttaaccggtaaggtttaaagttttaacgttaacgggttacccgtttacccttaccggttaaccggggttttaaccgggtttttacccgggggggaaccccgggggttaacccgtaacggggtacccggttaagggtaaccggtaaaccggttaaaaccggtaaaaaccgggttccggttaacggggtaccgggttcccggtacggtaaccccgtaacccggttaacgtttacccgtttaaccggtttccccgttttaaaccttccccggttttaaccccccgg

SEQ ID NO: 3291 - DNA, 509 bp, Homo sapiens
  misc_feature: GYAE6OF01B8D5Q.39.31.C09.1.454.CMB.1.raw
  modified_base (503)..(503): a, c, t, g, unknown or other
  misc_feature (503)..(503): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcacatcagcagcctgcaggctgaagagtgtggctagtttattacgtgtcagctagtattatagtacgtctcagtacgtttgggaccgggtacagtctggagactacgaaacgtacgtgtggctgacacctatctagtcttcnttcccg

SEQ ID NO: 3292 - DNA, 596 bp, Homo sapiens
  misc_feature: GYAE6OF01AKK0T.39.31.C09.1.454.CMB.1.raw
  modified_base (386)..(386): a, c, t, g, unknown or other
  misc_feature (386)..(386): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgtttcacacaggtccaacaataagaattacttcgcttggtaccagcagaaaccaggacagcctactaagttcgctactatttacgtggcatccgtacccgggagtcccgggtacctgaccgtattcaggcggcaggccggtctagagacgaggtactttcgacttctaccaacctntccagccaacgcctacgacacggctagtaagagttacggaggtacgtagttttacttacgtacgtactagtcctaagttactttaataggttaacgttcctacgtacggttacgttttcgggacccggggactaggtcgtaggtaagacgtacgtaaaacgtacgttaggtcggactacgacctaccgtacttacgtgttcctgtacccg

SEQ ID NO: 3293 - DNA, 515 bp, Homo sapiens
  misc_feature: GYAE6OF01DGECB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctctaagttgctcatttactggcatcgtacccgggagtccggggtcctgaccgattcagcggcagcggtctgagacagatttcactctcactatccagcagcctgcaggcttagaagatgtggtctagtttattactgtcagctagtattatagtagtcctactagtacgtttgggaccgggacgagcgtaggagatacgaaacgtaactggtggctcgcactatactgttctctcgttcccg

SEQ ID NO: 3294 - DNA, 499 bp, Homo sapiens
  misc_feature: GYAE6OF01D6C87.39.31.C09.1.454.CMB.1.raw
  modified_base (491)..(491): a, c, t, g, unknown or other
  misc_feature (491)..(491): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccaacagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttatactgtcagcagtattatagtagtcctcagacttttggccggggaccaagctggagatcaaacgaactgtggctgcaccatctgtcttcntctccccg

SEQ ID NO: 3295 - DNA, 723 bp, Homo sapiens
  misc_feature: GYAE6OF01C7YAE.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtctccagactccctggctgtgtctctgggcgaggagggccaccatcaactgcaagtccagccagtagttgttttacacaggtaccaaacaataagaattacttcgtcttggtaccagacagaaaccaggacagcctacgtaagttcgctctatttacgcggcacgtcgtacccggacggtccggggtcctcgaccgtattcgacggccggacgtagggtccgggtctaggaacgtacacggttacttttacactcctaccacctaactccgaagccgtaacgtcccgtaggaccgaacgggtactaaggaaaggtagttcggttagggtaacgtttacgttttattaaccgttcgtactacggtactaagtttaactttaagtagttaccgtaccttacgttaacggttacggttttacgggggacccgggggtaaacctacggtacggtacgggtaaacgtacgttaaaccggtaaaaaccggtaccggtttgggttaacggggtccttaacgggtacccaacccgttaacgtttacccgttaccggtttacccttaccgttcccgtttacccccgg

SEQ ID NO: 3296 - DNA, 531 bp, Homo sapiens
  misc_feature: GYAE6OF01C45X2.39.31.C09.1.454.CMB.1.raw
  modified_base (511)..(511): a, c, t, g, unknown or other
  misc_feature (511)..(511): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctacctaagttgctcatttactgggcatcgtacccgggagtccggggtccctgaccgattcagcggcagcggtctgagacagatttcactctcacctatcagcagcctgcaggctaggaagtatgtggactagtttactactgtacagctaagtattatagtacgtcctcgagttacgtttcggggaccggggtaacacgcgtaggagtactacgaaaacgtactggtggtctggacaccncttctagtcttcgattcccg

SEQ ID NO: 3297 - DNA, 636 bp, Homo sapiens
  misc_feature: GYAE6OF01B6386.39.31.C09.1.454.CMB.1.raw
  modified_base (430)..(430): a, c, t, g, unknown or other
  misc_feature (430)..(430): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctcccgtggctgtgtctcgtgggcgagagggccaccatcaactgcaagtccagccagagttgtttacacaggtaccaacaataagtaattacttcgtcttacggtaccagacaagaaaccaggacacgcctactaagtgctatatttacgtggctagtccgtacccgggacggtcccggggtccctaggaccgtattcgaggcggacgaggccgggtctagacgacgagttacttccactctccaacatcagacacgcctgccgaggcctagaagntggtcgtacgttagtttacttacgtgtacgaagtactaagttattaagttacgtacgttaccctagtaacggttttacgggtttaccgggaccgggggtaacctagggtacggtaggaacgtaaactaaacccgaaacggttaactgggtaccgcgttaccgacctacgtaacgttccttagtttaccctcgtaccgtttcccccg

SEQ ID NO: 3298 - DNA, 572 bp, Homo sapiens
  misc_feature: GYAE6OF01DR7NF.39.31.C09.1.454.CMB.1.raw
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaataagaattacttcgcttggtaccagcagaaaccaggacacgcctcctaagttgctcatttacngggcatctacccgggngtccggggtccctgaccgattcagcggcaggcgggtctgagacagtatttccactctcaccatcagcacgcctgcaggctagaagagtgtggctaagttttatacttgtcagtctaagttattaatagttacgtcctacgtagttacgttttgggacccggggtaacaacggcgtaggacgtaactacgaaaaccggtaacgtggtacggcgttacgacctaaccctagttacctagtttcccttcgtaacctttccccg

SEQ ID NO: 3299 - DNA, 585 bp, Homo sapiens
  misc_feature: GYAE6OF01DGJ4C.39.31.C09.1.454.CMB.1.raw
  modified_base (401)..(401): a, c, t, g, unknown or other
  misc_feature (401)..(401): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataaagaattacttcgcttggtaccagacaagaaaccaggacagcctacctaagttgctcatttacgtggcatccgtacccggggacgtcccgggggtccctggacccgtattcacgccggcaggcggggtctggacgacagtatttcactctcaccatcagcacgcctgcnggactgaagtagtgtggtactagtttattacttgtcagtctaagttaatttattagttacgtaccttacgtagttacgttttacggggaccggggtaaccaggtcgtggaagtacgtacgaaaacgtaacgttaggtacggtcacggtccaaccgtacttacttgttccttcctacgttccccg

SEQ ID NO: 3300 - DNA, 659 bp, Homo sapiens
  misc_feature: GYAE6OF01DAGS2.39.31.C09.1.454.CMB.1.raw
  modified_base (299)..(299): a, c, t, g, unknown or other
  misc_feature (299)..(299): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttacacaggtaccaacaaataaagaattacttcgcttaggtaccagacagaaaccaggacagcctcctaagttgctctatttacgnggcatccgtaccgggagtccggggtccctgaccgattcagcggcacggcggtctgacgacgagtactttacacctctacaacccataccagacacgcccgtgaccgacgggctagaaacgtagttggtaggacttaaggttttaacttacgttggtaccctagtacttaagttatttaagttaaggttaacgttcccttacgtaaacgggtttaccggttttacgggggaaccccgggggttaaccaacggtacggttacgggaacgtaaaccgtaaccgaaaaaccggtacgttggtacgggtcctacggacccaacccgtacgtttccgttaggttccctttaccgcttttacccccg

SEQ ID NO: 3301 - DNA, 591 bp, Homo sapiens
  misc_feature: GYAE6OF01DX3DT.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgactcatttacgnggctatccgtacccgggacgtcccggggtccctgaccgtattcagcggcaggcggtctgagacagtatttcactctcacatcagcacgcctgcaggctagaagtagtgtggtactagttttatacgttgtactagtactagtatttaagtagttaacgttcctacgtacgttaccgttttacggggacccggggtaaccgacggtcgtaggaacgtaacgtaccgaaaacgtacgtaggttacggtcgtacgacccgtaaccgtacgtaccgttacgttaccttcgtcgtttaccccg

SEQ ID NO: 3302 - DNA, 526 bp, Homo sapiens
  misc_feature: GYAE6OF01C3B2X.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaaataagaattacttcgcttggtaccagcagaaaccaggacagcctcctaagttgctcaatttactgggcatccgtaccccgggagtccggggtcccctgaccgattcagcggcagcggtctgagacagatttcactctcacatcagcagcctgcaggctagaagatgtgctagtttatactgtcagcaagtattatagtagtcctcgagtacgtttcgggaccggggaccaagcgtggagataacgaaacgtaacgtggtgctcgaccacctatcttagttccttcgactttccccg

SEQ ID NO: 3303 - DNA, 620 bp, Homo sapiens
  misc_feature: GYAE6OF01DAL8G.39.31.C09.1.454.CMB.1.raw
  modified_base (298)..(298): a, c, t, g, unknown or other
  misc_feature (298)..(298): n is a, c, g, or t
  modified_base (335)..(335): a, c, t, g, unknown or other
  misc_feature (335)..(335): n is a, c, g, or t
  modified_base (380)..(380): a, c, t, g, unknown or other
  misc_feature (380)..(380): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttacacaggtaccaacaataagtaattacttcgcttcggtaccagacaagaaaccaggacagcctactaagtgctctatttacnggcagtccgtacccgggagtcccgggtcctgaccgtntcagccggcgacggcggtctggacgacagtactttcactctcacntcagcacgtctgcgaggtctagaacgtgtgtcggacttagtttatacgtgtacagtctaagttaattataggtacttccgtaacgtacgggttacggtttcggggaaccccggggtaactaacgggtcggtaagggtaacgtacgtaaaccggtaaaccggtaaccgttggggtacgtccgtacggtaccctaaccgttactttaccgttaccgtttaccttccgtacgtttaccccccg

SEQ ID NO: 3304 - DNA, 513 bp, Homo sapiens
  misc_feature: GYAE6OF01BS732.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcctacccgggagtcccggggtccctgaccgattcagcggcagcgggtctgagacagatttcactctcacatcagcagcctgcaggctgaagatgtggctagtttattactgtcagctagttattatagtagtcctacagtacgttttgggcccggggtaccaggctaggagtatacgaaacgtactgtggctgcacctatctgtcttcattcccg

SEQ ID NO: 3305 - DNA, 571 bp, Homo sapiens
  misc_feature: GYAE6OF01BFWT3.39.31.C09.1.454.CMB.1.raw
  modified_base (307)..(307): a, c, t, g, unknown or other
  misc_feature (307)..(307): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaccaggacagcctctaagttgctctatttactggctatcctacccgggngtcccggggtcctgaccgtattcagcggcaggcggtctgagacagatttcactctcaccatcagcacgcctgcaggctagaagtatggtggactagtttattactgtacagtactagttattaagtagttacgttacctacgagttacggttttcgggacccggggtaacctaggcgtaggaacgacgtaaccgaaaacgtacgtaggtcggtactaccgaccgaaccgtcttaccgttgtttaccgttcctcgtttacccccg

SEQ ID NO: 3306 - DNA, 535 bp, Homo sapiens
  misc_feature: GYAE6OF01CELF8.39.31.C09.1.454.CMB.1.raw
  modified_base (529)..(529): a, c, t, g, unknown or other
  misc_feature (529)..(529): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcagaaaccaggacagcctcctaagttgctctatttactggcatccgtacccgggagtcccggggtccctggaccgtattcagcggcaggcggggtctgagacagtatttcactctcaccatcagcagtcctgcaggctgaagatgtggctagtttattactgtcagcagtattatagttagtcctctagtacgtttcgggacggggtacctaagcgtaggagactacaaacggtaactggtaggtctcgacacctacttctagttccttcgtnttcccg

SEQ ID NO: 3307 - DNA, 589 bp, Homo sapiens
  misc_feature: GYAE6OF01DFHNQ.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagaattacttcgcttggtaccagcagaaaccaggacagcctctaagtgccctatttacnggcagtccgtaccgggagtcccgggtccctgaccgattcagcgcgagcggtctgagacagtatttcactctacaccatcagcaagcctgacgacggcgtagaagagtggtaggacgttaagttttacgttaacgttgtacgagtactaagttattaagtagttacgtcctacgtagttacgttttcgggaccggggtaacaaggtcgtaggaagtactaaccgtaaacgaacgtcggtacggtacgtcgacctaccgtattccgttacgttccttactacgttccccgttaccccg

SEQ ID NO: 3308 - DNA, 636 bp, Homo sapiens
  misc_feature: GYAE6OF01CWLPO.39.31.C09.1.454.CMB.1.raw
  modified_base (307)..(307): a, c, t, g, unknown or other
  misc_feature (307)..(307): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggagggccaccatcaactgcaagtccagccagtagttgtttacacaggtaccaaacaataagtaattacttcgcttggtaccagacagaaaccaggacacgacctacctaagttcgctctactttacgnggctatccgtacccgggtacggtcccggggtccacgtaccgtattcgacgccggcagggtccgggtctaggaacgtaacgaggtacttttaccacttcctaccgaccctactaccgaagtccacgtccctaggcgaacggcgtagaaagtgtacggtcggtacttagttttacttacgtgtacagtactagttaacttataggttactcctacgtacggttaccggtttcgggacccggggtaacacggtcgtagggactactaacgaaacgtacgtgtcggtctacgactaccgtaacttcgtacgtttacctcgttaccgttccccg

SEQ ID NO: 3309 - DNA, 502 bp, Homo sapiens
  misc_feature: GYAE6OF01D5315.39.31.C09.1.454.CMB.1.raw
  modified_base (496)..(496): a, c, t, g, unknown or other
  misc_feature (496)..(496): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtggctagtttattactgtcagcagttattatagtagtcctcagtacgtttggccggggacagcgtggagatacgaaacgactggtggctgcacctatctgtcttcnttcccg

SEQ ID NO: 3310 - DNA, 533 bp, Homo sapiens
  misc_feature: GYAE6OF01CQWZR.39.31.C09.1.454.CMB.1.raw
  modified_base (291)..(291): a, c, t, g, unknown or other
  misc_feature (291)..(291): n is a, c, g, or t
  modified_base (526)..(526): a, c, t, g, unknown or other
  misc_feature (526)..(526): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttacnggcatcgtacccggagtccggggtcctgaccgattcagcggcagcggtctgagacagatttcactctcaccatcagcagcctgcaggctagaagatgtggactagtttattactgtacagtctagtattaatagttacgtcctacgtacgtacgttttcgggaccggggtacacgcgtaggagtacgtacgaaacgtaacgtgtacggctacgccaacctctactgttccttctnttacccg

SEQ ID NO: 3311 - DNA, 517 bp, Homo sapiens
  misc_feature: GYAE6OF01BB22R.39.31.C09.1.454.CMB.1.raw
  modified_base (490)..(490): a, c, t, g, unknown or other
  misc_feature (490)..(490): n is a, c, g, or t
  modified_base (511)..(511): a, c, t, g, unknown or other
  misc_feature (511)..(511): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccgggtccctgaccgattcagccggcagcgggtctgagacagatttccactctcaccatcagcagcctgcaggctagaagatgtggctagtttattactgtcagcagtattatagtagtcctgagtacgtttcgggaccggggtacaggctaggagtataccgaaacgtactgtacggcncgaccactactctagtcttcnttcccg

SEQ ID NO: 3312 - DNA, 520 bp, Homo sapiens
  misc_feature: GYAE6OF01EVZWB.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctcatttacngggcatctacccgggagtccggggtccctgaccgattcagcggcaggcgggtctgagacagatttcactctcaccatcagcagcctgcaggctgaagatgtgctagtttatactgtcagctagtattatagtagtcctacgtagtacgtttcgggccggggtacaaggctaggagatacgaaacgtacgtgtggtctcgacaccgtatctagttccttctattcccg

SEQ ID NO: 3313 - DNA, 548 bp, Homo sapiens
  misc_feature: GYAE6OF01BJ2KA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatccgtacccgggagtccggggtccctgaccgattcagcgcagcgggtctgagacagatttcactctcacatcagcagcctgcaggctagaacgagtgtggactagtttatactgtcagtctagttattagtagtacgtcctacgtagtaccgttttgggacccggggtacaaggtctagggtagtacgtacgaaacgtacgttggtaggtctacgaccgaacctatccgttagtccttacgtattacccccg

SEQ ID NO: 3314 - DNA, 551 bp, Homo sapiens
  misc_feature: GYAE6OF01BC86V.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagtgctcatttactgggcatctacccgggagtccgggtccctgaccgattcagcggcagcggtctgagacagatttcactctcacatcagcagcctgcaggctagaagatggtgtactagtttatacgtgtcagctagtattatagtacgtcctcgtagtaccgttttacggggccggggtaaccacggtcgtagggacgtagtaacgaaaccggaacgttggtacggtcctacgacctaaccctagttccttacgttccttctccgttaccccg

SEQ ID NO: 3315 - DNA, 584 bp, Homo sapiens
  misc_feature: GYAE6OF01CHG5I.39.31.C09.1.454.CMB.1.raw
  modified_base (229)..(229): a, c, t, g, unknown or other
  misc_feature (229)..(229): n is a, c, g, or t
  modified_base (350)..(350): a, c, t, g, unknown or other
  misc_feature (350)..(350): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagaggccaccatcaactgcaagtccagccagagtgtttacacaggtaccaanaaataaagaattactcgcgttggtaccagcaagaaaccaggacagcctacctaagttgctctatttacgtggcatccgacccggagtccggggtcctgaccgatcgagcggcaggcggtcngagacagtatttcactctacaccatcagcagcctgcgagctagaagtagtcggtgtacgttagtttactacgtgtccagtactaaggttattaagtaacgtacgttacctcgtaacgttacggttttacggggaccggggtaaccaggtcgtaggagaacgtaacgtaaaacgacgtggtacggcgttacggacctacgtacgttactagtttccgttacctcgtttacccccg

SEQ ID NO: 3316 - DNA, 522 bp, Homo sapiens
  misc_feature: GYAE6OF01BCSR6.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtcctgaccgattcagcggcaggcggtctgagacagatttcactctcaccatcagcagcctgcaggctgaagatggtggctagtttattacgtgtcacgcagttattaattagtacgtcctctagtacgttttcgggaccggggtacacgcgtggagtactacgaaacgaactgtcggctcgcacctacttctcgtcttctcttcccg

SEQ ID NO: 3317 - DNA, 665 bp, Homo sapiens
  misc_feature: GYAE6OF01C6RX4.39.31.C09.1.454.CMB.1.raw
  modified_base (341)..(341): a, c, t, g, unknown or other
  misc_feature (341)..(341): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggacgggccaccatcaactgacaagtccagccagagttgtttaacacaggtaccaaacaataagaattacttcgcgttaggtaccagacaagaaaccaggacagcctactaagttcgaccctatttacgtgggctagtccgtacccgggcgtcccgggtccngaccgtattcgaggcgcgacggcggtctaggacgacagtacttcacctctacacatcagcacgccgtgcgaggacgtagaagtagtgtacggtacttaagttttacgttacgtgtacgacgtacgtaagttaacgttaagtaacgttacgttaccgtacggttacggtttaaccgggttttcggggaaccccgggggttaacgtaacggtacggtaagggaaacgtaacggtaaacccgtaaaacggtaacggttcggtacggtacgtcggaccctacgtacgttcgttacgttaccttacctacccgttcccgttaacccccg

SEQ ID NO: 3318 - DNA, 560 bp, Homo sapiens
  misc_feature: GYAE6OF01B2EU7.39.31.C09.1.454.CMB.1.raw
  modified_base (346)..(346): a, c, t, g, unknown or other
  misc_feature (346)..(346): n is a, c, g, or t
  modified_base (391)..(391): a, c, t, g, unknown or other
  misc_feature (391)..(391): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcaagaaaccaggacagcctacctaagttgctcatttactgggcatcgtacccgggagtcccgggtcctgaccgattcgagcgcagcggtcngagacagtatttcactctcacatcagcagcctgcaggctagaagntgtgatagtttatactgtcagctagttatatagtacgttcctacgtacgttacgttttcggggacccggggtaaccaacggtcgtagggaacgtaacgtacgaaaacgtacgttaggtcgggtcctacggaccaacccgtattccgttagttccttcgtacgttccccg

SEQ ID NO: 3319 - DNA, 677 bp, Homo sapiens
  misc_feature: GYAE6OF01ETQ97.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgtttacacagtaccaaacaataagaattactcgcttggtaccagcaagaaaccaggacacgcctacctaagttcgctctatttacgngggcagtccgtacccgggacggtcccgggtccctggacccgtattccgaggccggcgacggtcgggtcgtagaacgactagtactttcaactctaccacctagtacagcacgtcctacgccgaggcgtaggaacgtagttggtagggtacctttaaggttttacttacgttacgtacgaacgtaccttaaaggttaatttaacgtaacggtttacgtacccgttagtaaccggtttaccggttttcgggggaaccccgggggtaacaacggtcgtaaggggaactaaacgtaaccgtaaaaacggttacgttaggtacggttccgacgaccctaacgttacgttccgttacgtttaccttaccgtaaccgtttccccgg

SEQ ID NO: 3320 - DNA, 547 bp, Homo sapiens
  misc_feature: GYAE6OF01EX50O.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataaagaattacttcgcttggtaccagcagaaaccaggacagcctacctaagttgctcatttacngggcatctacccgggagtccggggtccctgaccgattcagcggcaggcgggtctggagacagatttcactctcaccatcagcagcctgcaggctgaagatgtggctagtttattactgtacagtcagttattatagttagtcctacagttacgtttcgggacccggggtaaccaaggtcgtaggtaacgtagtaccgaaacggtacgtggtacggtctacgacacctatacgttgttcttccgtacgttcccg

SEQ ID NO: 3321 - DNA, 611 bp, Homo sapiens
  misc_feature: GYAE6OF01A1U5V.39.31.C09.1.454.CMB.1.raw
  modified_base (471)..(471): a, c, t, g, unknown or other
  misc_feature (471)..(471): n is a, c, g, or t
  modified_base (578)..(578): a, c, t, g, unknown or other
  misc_feature (578)..(578): n is a, c, g, or t
  modified_base (585)..(585): a, c, t, g, unknown or other
  misc_feature (585)..(585): n is a, c, g, or t
tcagtcgcactagtcacgaccggtgctcgatttagacgtctcatcaaggaaggaaggggacgagcaagatggtgttgcagacccaggtcttcatttctctgttgctctggatctctggtgcctacggggacatcgtgatgacccagtctccagactccctggctgtgtctcgtgggacgagagggcccaccagtcaactgcaacgtccagccagagttgtttacacgaggtaccaacaataagaattacttcgcttggtaccagcaagaaccaggacacgcctactagtgcctctatttacgggtccatccgtacccggggagtcccggggtccctacgaccgtattcgacggccggtacacgggtccgggtctggaacgaccgagtacctttcgaccttccgccaaccatccgaagcaccgcctgtcaacggtcgtagaacgtgtacgtggtctagtttattactggtanacggacttagtagtttactagttacgtccgtacttacggttacgtttaccgggtaccggggaactaggccgtaaggtagacgttaacgaaacgtacgtggcggtacngtaaccncgttactcgtagtcttgtactccccg

SEQ ID NO: 3322 - DNA, 688 bp, Homo sapiens
  misc_feature: GYAE6OF01AZE8Y.39.31.C09.1.454.CMB.1.raw
  modified_base (118)..(118): a, c, t, g, unknown or other
  misc_feature (118)..(118): n is a, c, g, or t
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
  modified_base (413)..(413): a, c, t, g, unknown or other
  misc_feature (413)..(413): n is a, c, g, or t
tcagtcgcactagtcacgaccggtgctcgatttagacgtctcatcaaggaaggaaggggcagcaagatggtgttgcagacccaggtcttcatttctctgttgctctggatctctggtncctacgggacatcgtgatgacccagtctccagactccctggctgtgtctctggcgagaggccacatcaactgcaagtccagccagagttgtttacacgtaggtccaacaataagaattacttcgcttaggtaccagcagaaaccnggacagcctactaagttgctacatttacgngggcagtccgtacccgggacgtccggggtccctggacccgtattcgagcggtcacggtcgggtctgagacgagatttcactcgtacaccatcgagtcaggtcctgcgacgctagaacgtntagtcgtactacgtttatactgtacgtagtccgtagttacttaacgtagttagtacccgttacgtacgttaccgttttacggggacccgggggtaacctaacgggtaccgtagggtaaacgtaccggttaaaccggtaaaaaccggtaaccggtttacgggttaacgggtccccgttaaaccggggtaaccctttaaaccccgggtacgtttttaaccccggggtttaggtttaacccccgttttaacccggtaacccgttttaaaccccccggg

SEQ ID NO: 3323 - DNA, 598 bp, Homo sapiens
  misc_feature: GYAE6OF01CM9WZ.39.31.C09.1.454.CMB.1.raw
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
  modified_base (578)..(578): a, c, t, g, unknown or other
  misc_feature (578)..(578): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtcgatcgacccagtcctccacgacctccctggctgtgtctcgtgggcgaggaggccaccatcaactgacaagtccagccagagtgttttacacaggtaccaaanaaataaagaattacttcgcttggtaaccagcaagaaaaccaggacagcctacctaagttcgctctatttacnggcatccgtacccgggagtccggggtccctagaccgtattcgagcggcaggcggtcngagacagtatttcactctacaccatcgancacgtcctgcaggcagaagagtgtggtactagtttattacgtgtaccatcgaagttattaattagttaacgtccttcgtaacgttacgttttacggggaccggggtaacccaggtaccgtaggaacgaagttaacgaaacgtaacgtaggtaggtacgtacggaccaaccgtactacgttnttacttcgtaacgttccccg

SEQ ID NO: 3324 - DNA, 532 bp, Homo sapiens
  misc_feature: GYAE6OF01BRKIW.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcagtctacccgggagtccggggtccctgaccgattcagcggcagcggtctgagacagatttcactctcaccatcagcagcctgcagctagaagatgtgctagtttattactgtcagctagtattagtagtagtcctacagtacgttttgggcccggggtaacaacggtcgtagggacgtacgtacgaaaacgtacgtgtggtctacgccaacctacttactgttcttcgtcttccccg

SEQ ID NO: 3325 - DNA, 598 bp, Homo sapiens
  misc_feature: GYAE6OF01C94A2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctggcgagagggccaccatcaactgcaagtccagccagagtgtttacacaggtaccaacaataagaattacttcgcttggtaccagcaagaaacaggacagcctactaagtcgctctatttactggcactccgtacccggacgtccgggtccctcgaccgattcgagcggctagcggtctgagacagtatttcaactctacaccatacagcacgcctgcacggctagaacgtatggtggtacttagtttattacgtgtacagctaagttattaagtagttactacctaccgtacggttaccgtttcggggacccggggtaactacgggtaccttagggaacgtaacgtaaaccgtaaacggtaaacgttcggtagggtcctacggacccaaccgtacgttactaccgtttcccttgtaccctttacccccg

SEQ ID NO: 3326 - DNA, 583 bp, Homo sapiens
  misc_feature: GYAE6OF01DYDPE.39.31.C09.1.454.CMB.1.raw
  modified_base (382)..(382): a, c, t, g, unknown or other
  misc_feature (382)..(382): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagacagaaaccaggacagcctacctaagttgctctatttaactggggacatccgtacccggggtagtcccgggggtccctgaccgattcagcggcagcgggtctgagacagatttcactctcaccatcancagcctgcaggctagaagatgtaggtctagtttattactgtcagtctagtaattactagttaacgtcctacgtaagtacgttttcgggaccgggggtaaccaaggtaccgtaggaacgacttaacgaaaacggtaaacgttaggtacgggtcgttacgaccaacctacttacttaggtttaccttccgtaacgtttccccg

SEQ ID NO: 3327 - DNA, 504 bp, Homo sapiens
  misc_feature: GYAE6OF01E2RZA.39.31.C09.1.454.CMB.1.raw
  modified_base (499)..(499): a, c, t, g, unknown or other
  misc_feature (499)..(499): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagttattatagtcgtcctcagtacttttggccgggggtaccaagcgtggagatacgaaacgactgtggctgcaccatctgtcttcnttccc

SEQ ID NO: 3328 - DNA, 543 bp, Homo sapiens
  misc_feature: GYAE6OF01D2660.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgctcatttactgggcatctacccggggagtcccggggtccctgaccgattcagcggcagcgggtctgagacagtatttcactctcaccatcagcacgcctgcgaggctagaagatgtggctagtttattactgtcagtactagttattatagtagttcctactagtacgttttcgggacccggggtaacgacggcgtaggagtacgtacgaaacgtaacgtggtaggtcgtacgacaccgtatctagttcttcacttcccg

SEQ ID NO: 3329 - DNA, 557 bp, Homo sapiens
  misc_feature: GYAE6OF01DKZBA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgttttacacaggtaccaacaataagaattacttcgcttggtaccagcagaaaccaggacagcctacctaagttgctctatttacgtggcatccgtacccgggagtccggggtcctgaccgattcagcggcaggcggtctgagacagtatttcactctcacatcagcacgcctgcgagctagagtagtgtggacttagtttattacgtgtcagtctattattagtagtatcctacgacgttacgtttacgggaccggggtaaccaaggtcgtaggaagtacgtaacgaaacgtaacgtggacggtcgtcgaccaccgtatcgttacgttaccttcgactttccccg

SEQ ID NO: 3330 - DNA, 589 bp, Homo sapiens
  misc_feature: GYAE6OF01EM91E.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttttacacaggtaccaaacaataagaattacttcgcttgtaccagcaagaaaccaggacagcctactaagtgctcatttacgtggcatcgtacccgggagtcccgggtcctgaccgattcgacgcggcaggcgggtctggagacagtactttcactctcaccatcagacagcctgcgacgtcgtagaagagtggtagacgtagtttacttacgtgtcagtcgtaagttattaagtacgttagtacccttacgtacggttaccggttttacgggacccgggggtaaccaaggtcggtaaggtagtaacgtaaccgaaacgtacgttaggtacggtcgtacgacctaacctacgttactagttccttcgcgttaccccg

SEQ ID NO: 3331 - DNA, 530 bp, Homo sapiens
  misc_feature: GYAE6OF01APWVQ.39.31.C09.1.454.CMB.1.raw
  modified_base (290)..(290): a, c, t, g, unknown or other
  misc_feature (290)..(290): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (382)..(382): a, c, t, g, unknown or other
  misc_feature (382)..(382): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
tcagtcgcactagtcacgaccggtgctcgatttagacgtctcatcaaggaaggaaggggcagcaagatggtgttgcagacccaggtcttcattctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaccaggacagcctcctaagtgctcatttacgnggcatctacccgggagtccggggtccctgaccgatcagcgcagcggtctgagcagntttcactcncaccatcagcagcctgcagctagaagntgtgctagtttactactgtcagctaagttattaactagtacgtacctcgtagttacgtttcgggaccgggtacgaagtcgtaggacgtacgtaacaacggtaccgtaggtcggacttgacctacgtntcgttntccttcncgttcccg

SEQ ID NO: 3332 - DNA, 590 bp, Homo sapiens
  misc_feature: GYAE6OF01EXA11.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatccgtacccgggagtcccgggtcctgaccgattcagcggcagcggtctgagacagtatttcactctcaccatcagcacgcctgcgaggctagaagatgtggctagtttattacgtgtcgagctagttattagtagttacgttacctcgtaggttaccgttttacgggacccgggggtaacctaacggcgttagggacgtaacgtaacgtaaaaccggtaacgttaggttacggcgttacggacccaacccgttaacgttccgttacggttcctttacccgtcgtttacccccg

SEQ ID NO: 3333 - DNA, 844 bp, Homo sapiens
  misc_feature: GYAE6OF01DJLLD.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagagggccacatcaactgcaagtccagccagagttgttttacacgacggtaccaacaaataagtaattaccttcgacttggtaacccagtacaacgaaaaccaggaaccaacggacccttaccgttaaagttcgaccttacgtaacgttttaaccgtcgggactaacgttacccgtaaccccgggggtacgggttaccccgggggttcccctacgggtaacccggtactttccggaacggtccgggtaccgaacgggtcccggggttacttacgggaacggtaaccgtaacggttaactttttaccaacctttcccttaaccgaaccctaacgtacccgaggtacccaccggtacccgtacggaccggtacggtaccgtaaggtaaagtacgttagggtaaccggttacgtttaagtttttaaccgttacggttcgtaaccgtaacgtacgttaagtttaaacgttaacgtttaacgttacccggttacccttaacggttaccggttttaacccggggtttaccgggggaaccccgggttaaaccgtacggtaccggtaacgggtaattaaaccgtaaaccggtaaacgtaccggttaggtacggtccgtaccggaacctaccgttacgtttaccgtacctttaccgttacgtacccgtttacccccgg

SEQ ID NO: 3334 - DNA, 579 bp, Homo sapiens
  misc_feature: GYAE6OF01ET1YY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgttttacacaggtccaaacaataagaattacttcgcttggtaccagcaagaaaccaggacagcctcctaagttgctctatttactgggcatccgtacccgggagtcccggggtccctgaccgattcagcggcaggtcgggtctgagacagtactttcactctacaccatcagcacgcctgccaggctaggaacgtagtgtggtactaagttttacttacgttgtactacgactaagttattattagtacgtcctacgtaggttaccgttttcggggacccggggtaacaggtccgtaggagtacgtaaccgaaacggtacgttgggtcgtcgtcgaccacgtattcttagtacttcgcgttaccccg

SEQ ID NO: 3335 - DNA, 614 bp, Homo sapiens
  misc_feature: GYAE6OF01BU395.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagtgtttacacaggtaccaaacaataagaattacttcgcttggtaccagcaagaaaccaggacagcctacctaagtttctctatttacgtgggactactccgtaccccggggacggttccccgggggtccctcggaacccgtatttccgaaggccggcaggccgggtctaggagacagtactttcactctcaccatcagcacgcctgcgaggctagaagtatgtacggtactagtttaacttacgtgtacagactagttattatagtactctacgtacgttacgtttacgggaccgggtaacaaggtcgtaggaagtaacgtaccgaaacgtacgttggtacggtactcggaccctaaccgtacttccgttacgttacctttacctaccgtttcccgttacccccg

SEQ ID NO: 3336 - DNA, 599 bp, Homo sapiens
  misc_feature: GYAE6OF01AYTBI.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacacggtccaacaataagaattacttcgcttggtaccagcaagaaaccaggacagcctacctaagttgctctatttacgtgggctatccgtacccggggacggtcccggggtccctcggaccgtattccgaggtccggcgaggcggggtctgacgacagtatttcactctcaccatcagcacgcctgcgaggtctagaacgtattggtaggtcttaagtttacttaacgtgtacagtctaagttattaagttgtacgttcctacgtaggttacggtttcggggaccgggtactaaggcgtagggacacgtaaccgaaacggtacgttggtcggtcctacggacctaacccgtattccgttacttcttaccgtcgttcccccg

SEQ ID NO: 3337 - DNA, 516 bp, Homo sapiens
  misc_feature: GYAE6OF01DNHIK.39.31.C09.1.454.CMB.1.raw
  modified_base (431)..(431): a, c, t, g, unknown or other
  misc_feature (431)..(431): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgaccccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacgtggcatcctacccgggagtccggggtccctgaccgattcagcggcagcgggtctgagacagatttcactctcaccatcagcagcctgcaggctagaagatgtgctagtttatactgtcagctagtattatagtatcctntagtcgtttggaccggggtacagctaggagactacaaacgtacgtggtcggctacgccaacctattactgttcttcgacttcccg

SEQ ID NO: 3338 - DNA, 592 bp, Homo sapiens
  misc_feature: GYAE6OF01C5UXJ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatcgtacccgggagtcccggggtcctgaccgtattcagcggcaggcggtctgagacagtatttcactctacaccatcagcacgcctgcagtctagaagttatttttgtaacttttaataccgtgtacaagtcctaagttatcgaacttacctgggcccttacaaccgtttacgttttcggacccggaagggggtaccctaggggttacgaagtaacgtaaccgaaaacggtacgttggtacggtctcggacccaaccgtattccttaggttcctttacacttttcccgtacccccgg

SEQ ID NO: 3339 - DNA, 673 bp, Homo sapiens
  misc_feature: GYAE6OF01DHG49.39.31.C09.1.454.CMB.1.raw
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccacatcaactgcaagtccagccagtagttgtttacacaggtaccaaacaaataagtaattacttcgtcgttcggtaccagacaacgaaaccaaggacacgacctacctaagttcgctntatttacgnggctactccgtaccgggcgtaccgggtcctgaccgtatcgagcgcaggcggtcaggacacagtacttcactccacaccatcagtcacgcctgacgaggcagaatgtggtacggtacttaaggtttacttacgtagtacgtacgtaacgtagtttaatttaagtaacgttacgttaccctacgtaacggttttaacccgggtttacggggaaccccggggttaaccgtaacggtcggtaacgggtaaacgtaaccggttaaaacctaaaaaccgggtacgttacggggtacggttaccggttacgaaccccgtaacgttaacgttccccgttaggtttcccttaacctaaccgttttcccccg

SEQ ID NO: 3340 - DNA, 525 bp, Homo sapiens
  misc_feature: GYAE6OF01EGY1A.39.31.C09.1.454.CMB.1.raw
  modified_base (356)..(356): a, c, t, g, unknown or other
  misc_feature (356)..(356): n is a, c, g, or t
  modified_base (490)..(490): a, c, t, g, unknown or other
  misc_feature (490)..(490): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctctatttactgggcatcctacccgggagtccggggtccctgaccgattcgagcggcagcgggtctgagacagntttcactctcaccatcagcagcctgcagctagaagatgtggctagtttatacgtgtcagctagtatatagtagtactcagtacgtttggccgggtacacgcgtaggagtagtacgaaacgtaacgtgtcggtcngtaccaccctattcgtagttccttcgacttccccg

SEQ ID NO: 3341 - DNA, 590 bp, Homo sapiens
  misc_feature: GYAE6OF01DJLM8.39.31.C09.1.454.CMB.1.raw
  modified_base (549)..(549): a, c, t, g, unknown or other
  misc_feature (549)..(549): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccacatcaactgcaagtccagccagagtgttttacacaggtaccaacaataagaattacttcgcttggtaccagcaagaaaccaggacagcctacctaagttcgctctaatttacgtgggcagtccgtacccggggagtcccggggtccctgacccgattcgagcgcagcggtctgagacagtatttcactctcacctatcagcagcctgcgaggctaggaagtattggtaggtcttagttttatacgttgtcgagtctaagtttattaagtaagttacgtcctacgtaggttaaccgttttacggggacccggggtaaccgtagtcgtaggtaagtactaacgaaaacggtaccgttggtacggtccnggtacccactaacgttcgtagtttccttagacctttccccg

SEQ ID NO: 3342 - DNA, 635 bp, Homo sapiens
  misc_feature: GYAE6OF01ED5F7.39.31.C09.1.454.CMB.1.raw
  modified_base (398)..(398): a, c, t, g, unknown or other
  misc_feature (398)..(398): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgtttacacagtaccaaacaataagaatttacttcgcttggtaccagacaagaaaccaggacagcctactaagttcgctactatttacgtgggacagtccgtacccggggtacgtcccggggtccctaggaccgtattcgagcggcgacggtcggtctaggacgacgtagtactttcactcacaccntacagcacgtcctgacgacggacgtagaagtagtggtacggtacgttaagttttacttacgtgtacgtaacgtacgtaagtttaatttaagtacgttaccgttaccgttacgttagttaccggtttcggggacccggggtaaccgacggtcggtaggaacgtacgtaacgaaacggtacgttaggtcggtacacgtaccaccgttacgttcgttacgttcttccgtccgttaccccg

SEQ ID NO: 3343 - DNA, 515 bp, Homo sapiens
  misc_feature: GYAE6OF01EKQ93.39.31.C09.1.454.CMB.1.raw
  modified_base (366)..(366): a, c, t, g, unknown or other
  misc_feature (366)..(366): n is a, c, g, or t
  modified_base (417)..(417): a, c, t, g, unknown or other
  misc_feature (417)..(417): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctcatttactgggcatccgtacccgggagtccggggtccctgaccgattcagcggcaggcggtctgagacagactttcactcncaccatcagcagcctgcaggctgaagatgtggctagtttattactgtcagntagtattatagtagtcctcgtagtacgttttcgggccggggacgagcgtggagatacgaaacgtactagtggctgacactactctgtcttctcttccc

SEQ ID NO: 3344 - DNA, 526 bp, Homo sapiens
  misc_feature: GYAE6OF01CZGCH.39.31.C09.1.454.CMB.1.raw
  modified_base (504)..(504): a, c, t, g, unknown or other
  misc_feature (504)..(504): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcaagaaacccaggacagcctacctaagttgctcatttactggcatcctacccgggacgtcccggggtcctgaccgattcagcggcagcgggtctggagacagtatttcactctcacatcagcagcctgcaggctagaagagtgtggctagtttatactgtcagtctaagtatttatagttactccttactagttacgtttcggccggggtacagcgtaggagagtacaaacgtacgtagtcggcgcgnaccgtatctgtcttctatcccg

SEQ ID NO: 3345 - DNA, 512 bp, Homo sapiens
  misc_feature: GYAE6OF01CBU27.39.31.C09.1.454.CMB.1.raw
  modified_base (476)..(476): a, c, t, g, unknown or other
  misc_feature (476)..(476): n is a, c, g, or t
  modified_base (507)..(507): a, c, t, g, unknown or other
  misc_feature (507)..(507): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgtattcagcggcagcgggtctgagacagactttcactctcaccatcagcagcctgcaggctagaagatagtggctagtttacttactgtcagcgaagtattatagttagtcctcagtacgttttggccggggtaccaagcgtaggagatanaaacgactagtggctgcactatctgtcttcnttccc

SEQ ID NO: 3346 - DNA, 701 bp, Homo sapiens
  misc_feature: GYAE6OF01CO1M4.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgagacggccaccatcaactgcaagtccagccagagttgtttacacaggtaccaaacaataagtaattacgttcgcgttaggtaaccagaccaagaaaaccaggacacgacctacctaaagttcgtcctactaacttttaccggcgggtacctacgttacccggtaaccccggggtacggttccccgggggttaccctacggaaccccgttacgttaccgaacggccgggaccgacgggtccgggttacgtacggaacgtaccgtaaggttacttttaccgaccttctaccgaacctatcgaacgtcacgtcctagcgaggtctaaggagtacgtgggtacgtacttaaggtttacttacgtcggactagtactaaaggttacttaagtagttaccttaccgttacgtaacgggtttaccgtttacgggggacccgggtactacgggtcgtacgaacgtactaacgaaacgtcgtggtacggtctacgacctacctacttcgtatttccttacgtcgttaccccg

SEQ ID NO: 3347 - DNA, 548 bp, Homo sapiens
  misc_feature: GYAE6OF01BY6D1.39.31.C09.1.454.CMB.1.raw
  modified_base (310)..(310): a, c, t, g, unknown or other
  misc_feature (310)..(310): n is a, c, g, or t
  modified_base (366)..(366): a, c, t, g, unknown or other
  misc_feature (366)..(366): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatccgtacccgggngtccggggtccctgaccgattcagcgcagcgggtctggagacagtactttcactcncaccatcagcacgcctgcgaggctagaagagtgtggtactagtttattactgtcagtctagttattatagtactcctagtagttacgtttcgggaccgggtacaggtcgtaggagtacgtacgaaacggtacgtggtcggcgtcgacctacctacttcgtacgttccttcgtcgttaccccg

SEQ ID NO: 3348 - DNA, 572 bp, Homo sapiens
  misc_feature: GYAE6OF01DX0TI.39.31.C09.1.454.CMB.1.raw
  modified_base (293)..(293): a, c, t, g, unknown or other
  misc_feature (293)..(293): n is a, c, g, or t
  modified_base (394)..(394): a, c, t, g, unknown or other
  misc_feature (394)..(394): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagtattactcgcttggtaccagcagaaaccaggacagcctactaagttgctctatttacngggcagtcgtacccgggagtcccggggtcctgaccgtatcagcgcaggcggtctgagacagtattcactctacacatcagcagcctgcgagctgaagatgnggtactagtttactacgtgtacgagtctaagtattatagtacgtacctagtacgttacgtttggggacccggggtactacggcgtaggtaacgagttaaccgaaaacggtacgttaggtgggtacccttaggaccgtaacctacgttacgttacggttcttcctaacgtttacccccg

SEQ ID NO: 3349 - DNA, 532 bp, Homo sapiens
  misc_feature: GYAE6OF01EIUK8.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccgggtccctgaccgattcagcggcagcggtctgagacagatttcactctcaccatcagcagcctgcagctgaagatgtggctagtttatactgtcagcagttattatagtagtcctacagtacgttttgggcccggggtactaacgcgtaggacgtacgtacgaaacgtacgtggtcggtctacgccgaaccgtacttactagttcttcgtactttccccg

SEQ ID NO: 3350 - DNA, 794 bp, Homo sapiens
  misc_feature: GYAE6OF01DHGQW.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagagttgttttacacacggtaccaacaaataagaattacttcgcttacggtaccagacaacgaaaaccaggacagcctacctaagttcgactctaactttacgtgggactacgtccgtacccggggacggttcccgggggtccctacggacccgtaattacgacggtccgggacgacgggtccgggttacgtaggaacgaaccgtagttaacttttaccgaaccttcctaacccgaaccctaacgttaccgaacgacccgtaacgtcccgttcggacgaacggggtcctaagggtaaaagtacgttaggggttacggtacgtttaaacggtttttaactttaacggttcggtaaccgtaaggtaaccgttaaaggttttaacttttaacggttaacggttaaccgttaccccgttaacggttaacgggttttaacccgggtttttaccggggggaacccccgggggtaaccgtaacgggtccggttaagggaaacgtaactaaaccggtaaaacggtaacgttgggtacggtccgtacggtacccacccgttaagttccgttagttccttccgtcctttacccccgg

SEQ ID NO: 3351 - DNA, 571 bp, Homo sapiens
  misc_feature: GYAE6OF01B3LL8.39.31.C09.1.454.CMB.1.raw
  modified_base (290)..(290): a, c, t, g, unknown or other
  misc_feature (290)..(290): n is a, c, g, or t
  modified_base (386)..(386): a, c, t, g, unknown or other
  misc_feature (386)..(386): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagtgctcatttacnggcatctacccgggagtccggggtccctgaccgattcgagcggcagcggtctgagacagatttcactctcaccatcagcagcctgcaggctgaagngtgtgtctagtttattacgtgtacagtactaagttattagtagtaacgttcctacgtacgttacgttttcggggacccggggtaacctaacggtcgtagggacgtaacgtaaccgtaaaaccggtacgttaggtacggtcgtacgacccaaccgtacgttcttagttcctttcgtactttccccg

SEQ ID NO: 3352 - DNA, 580 bp, Homo sapiens
  misc_feature: GYAE6OF01ARWRH.39.31.C09.1.454.CMB.1.raw
  modified_base (310)..(310): a, c, t, g, unknown or other
  misc_feature (310)..(310): n is a, c, g, or t
  modified_base (372)..(372): a, c, t, g, unknown or other
  misc_feature (372)..(372): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaacccaggacagcctcctaagttgctcatttactgggcatcgtacccgggngtaccggggtccctgacccgattcgagcggcagcgggtctgagacagatttcactctcaccntcagcagcctgcaggctagaagatggtcgctagtttacttacgtgtcagctagtattagtagtagtcctacgtagtaccgttttcgggaccgggggtaccaaggctagggacgtacgtaaccgaaacggtaaccgttggtcggaccgtcggtaacccgtaaccccgtaacttaccgttacgtttaccctttcgtccgtttacccccgg

SEQ ID NO: 3353 - DNA, 508 bp, Homo sapiens
  misc_feature: GYAE6OF01C51KM.39.31.C09.1.454.CMB.1.raw
  modified_base (501)..(501): a, c, t, g, unknown or other
  misc_feature (501)..(501): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatcgtacccgggagtccggggtcctgaccgattcagcggcagcggtctgagacagatttcactctcacatcagcagcctgcaggctagaagatgtgctagtttatactgtcagctagtattatagtactctctagtacgtttgggaccggggaactagcgtaggagactacgaaacgtacgtggcggctcgcactactctgtctcncttcccg

SEQ ID NO: 3354 - DNA, 509 bp, Homo sapiens
  misc_feature: GYAE6OF01BQUPP.39.31.C09.1.454.CMB.1.raw
  modified_base (391)..(391): a, c, t, g, unknown or other
  misc_feature (391)..(391): n is a, c, g, or t
  modified_base (501)..(501): a, c, t, g, unknown or other
  misc_feature (501)..(501): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcacggctagaagngtgtggctagtttattactgtcagcagttatatagtatcctcagtacgtttgggccgggtacacgtgtggagactacgaaacgacgtgtggctgccactactctgtcttnacttcccg

SEQ ID NO: 3355 - DNA, 520 bp, Homo sapiens
  misc_feature: GYAE6OF01CHQAR.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccggggagtccggggtccctgaccgattcagcggcagcggtctgagacagatttcactctcaccatcagcagcctgcaggctgaagatgtggctagtttatacttgtacagctagtattagtagtagtcctacgagttcgtttcgggaccggggaccaggtctggagtaactcgaaaacgtactggtacggctgacactactctagtcttcattccccg

SEQ ID NO: 3356 - DNA, 585 bp, Homo sapiens
  misc_feature: GYAE6OF01D019W.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttacacaggtccaaacaataaagaattacttcgcttggtaccagacaagaaaccaggacagcctaccgtaagttcgctctatttacgtgggcagtccgtacccgggacggtccgggtccctgaccgtattcagcggcaggccggtctgacgacagtactttcactctcaccatcagcagcctgcaggctaggaagtagtggtcgacgttaagtttactacgtgtacgtagactagttattagtagttacgtccttacgtagttacgtttcgggacccggggtaaccagtcgtaggacgacgtaaaccgtaacggacgttggacggtcgtacgaccaccgtacttaccttggttccttctacgtttaccccg

SEQ ID NO: 3357 - DNA, 510 bp, Homo sapiens
  misc_feature: GYAE6OF01DKL9W.39.31.C09.1.454.CMB.1.raw
  modified_base (503)..(503): a, c, t, g, unknown or other
  misc_feature (503)..(503): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggtccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcagcggtctgagacagatttcactctcaccatcagcagcctgcaggctgaagatgtggctagtttattactgtcagctagtattatagtagtcctctagtacgttttgggccggggtaaccagcgtaggagatacgaaacgaactgtggctcgcaccactactgtcttntattccc

SEQ ID NO: 3358 - DNA, 564 bp, Homo sapiens
  misc_feature: GYAE6OF01AM9AY.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaccaggacagcctcctaagttgctcatttactgggcatctacccgggagtccggggtcctgaccgattcagcggcagcggtctgagacagatttcactctcacatcagcagcctgcaggctgaagatgtggctagtttattactgtcagctagtattagtagtagtacctacgacgttacgttttcgggacccgggggtaaccaacggtcgtacgggagtaacgtaccgaaaacggtaaccttgggttacggaccgttacggcctaacccgtacttaccgttcggttacttccgtacgtttaccccg

SEQ ID NO: 3359 - DNA, 505 bp, Homo sapiens
  misc_feature: GYAE6OF01BVUPO.39.31.C09.1.454.CMB.1.raw
  modified_base (500)..(500): a, c, t, g, unknown or other
  misc_feature (500)..(500): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcacatcagcagctgcaggctgaagatgtggctagtttattactgtcgagctagtattatagtagtcctcagtacgttttggccggggaccaggcgtggagatacgaaacgtactggtggctgcacctatctagtcttcngtccc

SEQ ID NO: 3360 - DNA, 610 bp, Homo sapiens
  misc_feature: GYAE6OF01AZ1PP.39.31.C09.1.454.CMB.1.raw
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacagacctcctaagttcgctctatttacgngggcatccgtacccggggagtcccggggtcctgaccgtattcagcggcaggcgggtctgacgacagtactttcactctacaccatcagcagcctgcaggctagaagtagtgtggactagtttacttacgtgtaccagtactagttattaattacgtacgttccttacgtacggttaccggttttacggggacccggggtaacctaagggtccgtagggaacgtaacgtaaccgaaaaaccggtacgttcggtacggtccgttacggaccctaacccggtattccgttacgttccctttacgtacgtttaccccg

SEQ ID NO: 3361 - DNA, 512 bp, Homo sapiens
  misc_feature: GYAE6OF01AMG1K.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtagctagtttatactgtcagcagttattatagtacgtcctcgagtacgtttgggaccggggtaccaggtctggagactacgaaacgtactgtcggctgcacctattctgtcttcgattcccg

SEQ ID NO: 3362 - DNA, 540 bp, Homo sapiens
  misc_feature: GYAE6OF01EQXG0.39.31.C09.1.454.CMB.1.raw
  modified_base (292)..(292): a, c, t, g, unknown or other
  misc_feature (292)..(292): n is a, c, g, or t
  modified_base (532)..(532): a, c, t, g, unknown or other
  misc_feature (532)..(532): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggggccaccatcaactgcaagtccagccagagtgttttacacaggtccaacaataagaattacttcgcttggtaccagcagaaaccaggacagcctctaagttgctcatttacngggcatcgtacccgggagtccggggtccctgaccgattcagcggcagcgggtctgagacagatttcactctcaccatcagcacgcctgcaggctgaagatgtgctagtttattactgtcagctagttattatagttagtcctacgtacgtacgttttcgggaccggggtaaccaaggtcgtaggacgtactacgaaacgtaacgtggtacggctacgaccaaccgtactacttgtcttcncgttcccg

SEQ ID NO: 3363 - DNA, 556 bp, Homo sapiens
  misc_feature: GYAE6OF01BD5GW.39.31.C09.1.454.CMB.1.raw
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagacagaaaccaggacagcctcctaagttgctntatttacngggcatccgtacccgggagtcccgggtccctgaccgattcgagcgcaggcgggtctgagacgagtatttcactctaccacatcagcacgcctgacgaggctagaagtatggtggtcttaagtttatactgtctagactagttattagtagttagtacctagtacgttacgtttacgggaccgggtaacaggtcgtaggagtacgtacgaaacgtacgttgtacggctacgaccacgtacttcttagttcttcgtccttcccg

SEQ ID NO: 3364 - DNA, 600 bp, Homo sapiens
  misc_feature: GYAE6OF01CXBE3.39.31.C09.1.454.CMB.1.raw
  modified_base (327)..(327): a, c, t, g, unknown or other
  misc_feature (327)..(327): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatgacccagtctccagactccctggctgtgtctctgggcgagagggccaccatcaactgcaagtccagccagagttgtttacacaggtaccaaacaataagtaattacttcgcttgtaccagacaagaaccaggacagcctactaagtcgctctattacgtggacactccgtaccgggacgtcccgggtccncgaccgtattcgagcggcaggcggtctaggagtacgtatacgtttcactctaccacctatccgagcacgcctgcgagtcgtagaacgtagtcggtagtacttagttttactacgtgtacgacgtactaagtttattaagttacgtaacgttcctagtacgtttacggtttccggggaacccggtacgtagccgttaggaactacgtaaacaacggtaacgttggacggtctacggaaccctacgtacttcgttcgttactcgtccttaccccg

SEQ ID NO: 3365 - DNA, 527 bp, Homo sapiens
  misc_feature: GYAE6OF01A6BEP.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgttttacacaggtccaacaataagaattacttcgcttggtaccagcagaaaccaggacagcctcctaagttgctcatttacngggcatctacccgggagtccgggtccctgaccgattcagcggcagcgggtctgagacagtatttcactctcaccatcagcagcctgcaggctagaagagtgtggactagtttattactgtcagctagtattatagtagtcctatacgtacgttttcgggaccggggtaccagcgtaggagataccgaaacgtacgtggtcggctgaccacgtactcgttagtccttcgacttcccg

SEQ ID NO: 3366 - DNA, 535 bp, Homo sapiens
  misc_feature: GYAE6OF01A565F.39.31.C09.1.454.CMB.1.raw
  modified_base (284)..(284): a, c, t, g, unknown or other
  misc_feature (284)..(284): n is a, c, g, or t
  modified_base (516)..(516): a, c, t, g, unknown or other
  misc_feature (516)..(516): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattactcgcttggtaccagcaagaaaccaggacagcctcctaagtgctnatttacgtgggctatccgtacccgggagtcccggggtccctgaccgattcgacgcggcacggcggggtctgaagacagtactttcactctacaccgatcaagcagctgacagctagaagtatgtaggctagtttattactgtacagctagttattatagtagtcctacgagttaccgtttgggaccgggtacagctaggacgatacgaaacgtacgtgcggctacgcaactntctagtcttcgacgttccc

SEQ ID NO: 3367 - DNA, 565 bp, Homo sapiens
  misc_feature: GYAE6OF01CWCDN.39.31.C09.1.454.CMB.1.raw
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggcccaccatcaactgcaagtccagccagagttgttttacacaggtaccaaacaataagaattacttcgcttggtaccagacaagaaaccaggacagcctacctaagttgactnatttacgnggacatccgtacccgggagtcccggggtcctggaccgattcaggcggacgaggccggtctagacgacgagtactttcactcgtacaccatcaagcacgccgtgcgagcgtagaagagtgtaggacttagtttacttactcgtacagtacgtaagttattagtagtacgttcctacgtacgttacgtttcgggaccgggtaccagtcgaggagatacgaaacgtacgtgcggtcacgacactactctattctctacgttcccg

SEQ ID NO: 3368 - DNA, 497 bp, Homo sapiens
  misc_feature: GYAE6OF01AI8GS.39.31.C09.1.454.CMB.1.raw
  modified_base (493)..(493): a, c, t, g, unknown or other
  misc_feature (493)..(493): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagtgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtactttggccggggtacagctggagatacaaacgaactgtggctgcaccatctagtcttcntccc

SEQ ID NO: 3369 - DNA, 543 bp, Homo sapiens
  misc_feature: GYAE6OF01BBUFP.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctacctaagttgctcatttactggcatccgtacccgggagtcccggggtccctggaccgattcaggcggcagcgggtctgagacagtatttcactctcaccatcagccagcctgcaggctagaagagtgtggctagtttattactgtcagctagttattatagttagtcctcgtagtacgttttcgggacccggggtaaccgagtcgtaggagtactacgaaacgtacgtaggtggctcgcaacccgtattccttagtccttcgtacttcccg

SEQ ID NO: 3370 - DNA, 597 bp, Homo sapiens
  misc_feature: GYAE6OF01CQJUA.39.31.C09.1.454.CMB.1.raw
  modified_base (415)..(415): a, c, t, g, unknown or other
  misc_feature (415)..(415): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttaacacaggtccaaacaataagaattacttcgcttggtaccagcaagaaaccaggacagcctacctaagttcgctctatttacgtgggcatccgtacccgggaggtccccggggtcctgacccgtattcgagcggcaggccggggtctgagacagtactttcactctcacctatcagcagcctgcgaggctagagatggnggtactagtttattactgtacagtactagttaattaagttacgtagttcctacgtacgttaccgtttcgggggacccggggactaaggtcgtaggacgtactaaccgaaaacggtcgttaggtacggtcctacggtaccccacgtacgttacctgtttaaccttcgttaaccgttccccccg

SEQ ID NO: 3371 - DNA, 644 bp, Homo sapiens
  misc_feature: GYAE6OF01CTX5Z.39.31.C09.1.454.CMB.1.raw
  modified_base (308)..(308): a, c, t, g, unknown or other
  misc_feature (308)..(308): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgagaggccaccatcaactgcaagtccagccagagttgtttacacaggtaccaacaaataagaatttacttcgtcttaggtaccagacaagaaaccaggacacgcctaccgtaagttcgctactatttacgnggactacgtccgtacccgggtacggtcccggggtaccctacgaccgtatcgacggccgcgaggccggtnagagacagtacttcgactcacacancagcacgcctgacaggctagaagtgtggtagtacttagtttactacgtgtacagacgttaagttaattacgtagttaccgttccgtacgtaacgtttacgggtttaccggggacccggggtaactacggtacggtaggtaacgtaaaccgtaaccgtaaaaacgggtccggttaggtaccgggtactaccggtaacccaccttacgttcctttacccggtactttcccgtactttccccccg

SEQ ID NO: 3372 - DNA, 605 bp, Homo sapiens
  misc_feature: GYAE6OF01BIGJ0.39.31.C09.1.454.CMB.1.raw
  modified_base (363)..(363): a, c, t, g, unknown or other
  misc_feature (363)..(363): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgtttacacaggtaccaacaataagaattactcgcttggtaccagcaagaaaccaggacagtcctacctaagttcgacctataactttacgtgggctagtccgtacccgggagtcccgggtccctagaccgtattcaggcgcgaggcgggtcnggagacgacgtatttccgactcgtaccaccatcagcacgcctgcgaggtcgtaggaagtacgtggtcgtacgttacgtttagttacgttgtactagtcgtaagttaacttagtagtaccgttctacgtaggttccgtttacgggaccgggtaccaggtacgaggtactacgtaaccgtaaacggtacgttggtacggcgtacgaactaccgtacttcgttacgtacttccgtacgttccccg

SEQ ID NO: 3373 - DNA, 663 bp, Homo sapiens
  misc_feature: GYAE6OF01DA83I.39.31.C09.1.454.CMB.1.raw
  modified_base (452)..(452): a, c, t, g, unknown or other
  misc_feature (452)..(452): n is a, c, g, or t
  modified_base (653)..(653): a, c, t, g, unknown or other
  misc_feature (653)..(653): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctcccgtggctgtgtctcgtgggcgagacgggccacatcaactgcaagtccagccagagttcgtttaacacgacggtaccaacaaattaaacgtaattaaccgttcgtcgttaggtaaccagacaacgaaaaccaggacaccgcctacgtaagtcgcttactagtttacgcggactacgtccggacccgggtacggtcccgggtccagaccgtatccgacgacggtcgaggtccgggtactaggacgtacgagtactttacacttccactaccatacgacgacgcgtaccgcgtacncggtacgtagaacgtaggtgtacggtaccgttagtttactacgtacgtaccgagtacgtaagtttaagtttacgtacgttacgtccttacgtaacggtttaccggttacggggacccggtaacgtacggacggtaagagtaacgtaaaccgaaacggttagacggtcgcgtacgaccctacttaagcttaccgtctttccngtttcccccg

SEQ ID NO: 3374 - DNA, 527 bp, Homo sapiens
  misc_feature: GYAE6OF01EPEI4.39.31.C09.1.454.CMB.1.raw
  modified_base (292)..(292): a, c, t, g, unknown or other
  misc_feature (292)..(292): n is a, c, g, or t
  modified_base (521)..(521): a, c, t, g, unknown or other
  misc_feature (521)..(521): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccctggctgtgtctctgggcgagagggccaccatcaactgcaagtccagccagagtgtttacacaggtccaacaataagaattacttcgcttggtaccagcagaaactaggacagcctcctaagttgctcatttacngggcatctacccgggagtccggggtccctgaccgattcagcggcaggcggtctgagacagatttcactctcaccatcagcagcctgcaggctgaagagtgtggctagtttattactgtcagtcaagttattatagttagtcctacgagtacgttttcgggccggggtacaaggcgtaggagtagtacaaacgtacgtaggtggccgtgcacccgtattctgtccttcgnttcccg

SEQ ID NO: 3375 - DNA, 745 bp, Homo sapiens
  misc_feature: GYAE6OF01B5T2B.39.31.C09.1.454.CMB.1.raw
  modified_base (215)..(215): a, c, t, g, unknown or other
  misc_feature (215)..(215): n is a, c, g, or t
  modified_base (299)..(299): a, c, t, g, unknown or other
  misc_feature (299)..(299): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccagagttntttacacaggtaccaacaataagaattactcgtcttgtaccagcaacgaaaccaggacacgcctacctaagtgctctattacgngggctactccgtacccgggtacggtcccggggtccctggacccgtattcgacggccggcgacggtccggggtactaggaacgacgtagtacttttaccgactccgtaccaaccctacttaccgaacgaccgtaaccggtccctacggaccgaacgggttaccgtaaggtaaacgtagttacgggttacggtacgtttaagtttttacgttaacgttacggtaccaaggtaccgtaagtttaacgtttaagtaacggtttaaccgttacccgttacgtaacgggttttaccggttttaccggggggacccggggttaaaccgtacggtacggttaacggggtaacgtaaaccgtaaacccgtaaaacggttacggttacgggtaccgggtaccttacggacctaacccgttacgttcgttacgttccgttacctacgttacccccgg

SEQ ID NO: 3376 - DNA, 518 bp, Homo sapiens
  misc_feature: GYAE6OF01E0KXA.39.31.C09.1.454.CMB.1.raw
  modified_base (512)..(512): a, c, t, g, unknown or other
  misc_feature (512)..(512): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctagaagatggtggctagtttattactgtcagcagttattatagtacgtcctcgagtacgttttcgggccggggtaccaaggtctggagtatacgaaacgaactgtaggctgacacctctctagtcttcnttcccg

SEQ ID NO: 3377 - DNA, 583 bp, Homo sapiens
  misc_feature: GYAE6OF01DSA8N.39.31.C09.1.454.CMB.1.raw
  modified_base (435)..(435): a, c, t, g, unknown or other
  misc_feature (435)..(435): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacgtgggcatccgtacccgggacgtcccggggtccctgaccgattcgagcggcaggcgggtctggacgacagtactttcactctacacatcagcacgcctgacaggctaggaagtagtggtggactaggttttacttacgtgtacngtactagttattagtagtacgttcctagtagttacgtttaggggcccgggtaactacgtcgtaggaagtactacgaaaccggtaacgttggtacggtccgtacgaccctaacccgtacttacgtacgtttccttcgtctttacccccg

SEQ ID NO: 3378 - DNA, 623 bp, Homo sapiens
  misc_feature: GYAE6OF01CX5L1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgagagggccaccatcaactgacaagtccagccagagttgtttaacacaggtaccaacaataaagaattacttcgcttaggtaccagacaagaaaccaggacagcctactaagttgctctatttacgtggactagtaccgtacccgggtacggtcccggggttccctagaacccgtattcgaacggcgggtcaggtccgggttcaggaacgacagtactttacactctacaacctatacagctacgcctgcgaggctagaagtagtggtacgtacgttaagtttattacgtgtacgtagactaagttattaagtaagttacgtactacgtaacgtacggtttaccgggaccggggtaaccgaaggtcgtaggacgaacgtaacgaaaacgtaacgtaggtcgtcgtaccgacaacctacgttacttagtccttacgtcgttaccccg

SEQ ID NO: 3379 - DNA, 568 bp, Homo sapiens
  misc_feature: GYAE6OF01A6UFL.39.31.C09.1.454.CMB.1.raw
  modified_base (397)..(397): a, c, t, g, unknown or other
  misc_feature (397)..(397): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggctatcctacccggggagtcccggggtccctggaccgattcagcggcaggcgggtctgagacagtatttcactctcaccatcagcagcctgcaggctagaagntgtgctagtttattactgtcagctagtattagtagtacgtcctcgtagttaccgttttaggggacccggggtaccaaggtcgtaggagtactacgaaaaccggtacgttaggtacggtctacggacctaacccgtagttaccttcggttcctttaccgtacgtttcccccg

SEQ ID NO: 3380 - DNA, 750 bp, Homo sapiens
  misc_feature: GYAE6OF01DX6CV.39.31.C09.1.454.CMB.1.raw
  modified_base (307)..(307): a, c, t, g, unknown or other
  misc_feature (307)..(307): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggagggccaaccatcaactgacaagtccagccagtagttgtttacacaggtaccaaacaataagtaattacttcgcttggtaccagacaagaaaccaggacagtcctactaagtgactactatttacgngggactactccggtacccgggtacggtcccggggtccctacggaccgtaacttcgacggccggcgacgggtccgggtacgtaggaaacgactaaggttacttttaccaccttcctacccaacctatacccgaacgccgtaacggtcccgtcgaccgtaacgggtaccgtaaggtaaaggtaacgttagggttacggtacgtttaaaggtttttaacttaccgttacgtacgtaacgtacgtaaagtttaagtttaacgtacggtttaacgttaccgttaaccgtaacgggtttaccggttttaccggggacccggggttaaccggaacggttaccggtagggtaacgtaaacggtaaccgtaaaacggtaccggttaggtacgggtccgtacggtaccgtaaccgttacttaccgttacgtttacttcgtaccgtttaccccg

SEQ ID NO: 3381 - DNA, 583 bp, Homo sapiens
  misc_feature: GYAE6OF01DNAVR.39.31.C09.1.454.CMB.1.raw
  modified_base (407)..(407): a, c, t, g, unknown or other
  misc_feature (407)..(407): n is a, c, g, or t
  modified_base (428)..(428): a, c, t, g, unknown or other
  misc_feature (428)..(428): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagaattacttcgcttggtaccagacaagaaaccaggacagcctcctaagttgctcatttacgtgggcactccgtacccggggagtcccggggtccctggaccgtattccgagcggcaggcgggtctggagacagtatttcactctcaccatcagcacgcctgcagctagaagntggtgctagtttatactgtanagtctaagttattaagtagttacgtacctacgtacgttaccgttttacggggacccggggtaacccaggtccgtagggaacgtaactaaccgaaaacggtaacgtaggttacggctacgacccaacgtacttacttcgtttcctcgtcttccccg

SEQ ID NO: 3382 - DNA, 752 bp, Homo sapiens
  misc_feature: GYAE6OF01C436A.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctcccgtggctgtgtctcgtgggcgagacggccaccatcaactgacaacgtccacgccaagtagttagttttacaacgacggtaccaaacaaagtaaagtaactttaccgttcgtacgttacggtaacccagaccaagaaaacccgaggaaccacggtcctaccttaagttcgcttactactttacgtcggacacgttaccgtaaccccggggtacggtcccggggtccctacggaacccgtattaccgagggaccggtacgacgggtccgggttacgtaggaacgaacgtacgttactttaccgtaacccttcctaaccaccctacgtaaccgacggacctaacgcccgtacggaccgaggtaccgttaggaaagtgttaggtacgggactttaaggtttactttacgtagtacgaacgtactaagtttattaacgtaaggttcctaccgttagtaaccggtttacggtttaccgggggaacccgggtaacgtacggtcggtacggtaagaacgtaaaccgaaacggtacggtaggtacggtccgtaccgacaacccgttcgtaccgtttacgttaccttccgttaccgttaccccg

SEQ ID NO: 3383 - DNA, 531 bp, Homo sapiens
  misc_feature: GYAE6OF01EKKJE.39.31.C09.1.454.CMB.1.raw
  modified_base (327)..(327): a, c, t, g, unknown or other
  misc_feature (327)..(327): n is a, c, g, or t
  modified_base (522)..(522): a, c, t, g, unknown or other
  misc_feature (522)..(522): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgnttcagcggcagcgggtctgagacagattcactctcaccatcagcagcctgcaggctagaagatggtgctagttttattactgtcagtctagttattatagtacgtctctagtacgttttcgggccggggtaccaaggtccgtggacgtagtacaaaacggtactaggtcggctagccaacctatcttattccttnacgttcccg

SEQ ID NO: 3384 - DNA, 556 bp, Homo sapiens
  misc_feature: GYAE6OF01DS23Y.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaataagaattacttcgcttggtaccagcaagaaaccaggacagcctacctaagttgctcatttacgngggcatccgtacccgggagtcccggggtcctgaccgattcagcggcagcggtctgagacagtatttcactctacacatcagcacgcctgacgaggctagaagtatggtgattagtttattacgtgtacagactagttattatagtagtacctacgtagtacgtttacgggacccgggtaacgagtcgtaggacgactaacgaaacgtacgtaggtacgcgtacgactaccgtactacttagttcttcgtcgttccccg

SEQ ID NO: 3385 - DNA, 529 bp, Homo sapiens
  misc_feature: GYAE6OF01EZ7F6.39.31.C09.1.454.CMB.1.raw
  modified_base (426)..(426): a, c, t, g, unknown or other
  misc_feature (426)..(426): n is a, c, g, or t
  modified_base (522)..(522): a, c, t, g, unknown or other
  misc_feature (522)..(522): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctctatttactgggcatccgtacccgggagtcccggggtccctgaccgattcgagccggcaggcgggtctggagacagtatttcactctcacctatcagcagcctgcaggctagaagtagtgtgacgtagtttattactgtcngtactagtattatagtctctcagtacgtttgggaccgggtacagtcgtggatacgtaacgaacggtactggtcggctgaccacctatctgtcttcncttcccg

SEQ ID NO: 3386 - DNA, 569 bp, Homo sapiens
  misc_feature: GYAE6OF01ETY7Q.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtccctgaccgattcagcggcagcggtctgagacagatttcactctcacatcagcacgcctgcaggctgaagatgtggctagtttattacgtgtcagctagttattagtagttacgtcctcgtagttacgttttcggggacccgggggtacctaacggcgtagggaacgtacgtaaccgaaacggtaacgttaggtacggtctacggacctaacccgtaacgttccgttagttcctttcgtacgtttacccccg

SEQ ID NO: 3387 - DNA, 552 bp, Homo sapiens
  misc_feature: GYAE6OF01ETC1J.39.31.C09.1.454.CMB.1.raw
  modified_base (401)..(401): a, c, t, g, unknown or other
  misc_feature (401)..(401): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctacctaagttcgctcatttacgtgggcatccgtacccggggaggtcccggggtccctggaccgattcagcggcaggcgggtctgagacagtatttcactctcaccatcagcagcctgcaggctagaagntggtggactagtttattactgtcagctagttattatagtctcctactaggttacgtttcggggacccggggtaacaggtcgtagggaacgtactaacgaaacggtacgtggtcggctcgacacctactcgttagttccttcgacttccccg

SEQ ID NO: 3388 - DNA, 702 bp, Homo sapiens
  misc_feature: GYAE6OF01C6RZS.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgtttacacaggtaccaacaaataagtaattacttcgcttaggtaccagacaagaaaccaggacacgcctcctaagttcgctactaatttacgtgggactacgtccgtaaccccggggaggttcccggggtccctggacccgtattccgacggcggcacgggtcggggtctaggagacgtagtactttcgaactcttaccaacctataccgagaccgaacgtcccgtcggaccgtacgggtaccgtaggtaaacggtagttcgggtacggtaacgtttaaggttttaacttaccgttaggtacgtacgaccgttaagttaatttaagttaacggttacgttacctacggtaacggttacggttttaccggggacccggggtaactacggtcgtagggtacgtaaccgtaaccgaaacggtaacgtggtacggtaccgtacggtaccctaaccgtacgttacgttacgttaccttccgtaccgtttcccccg

SEQ ID NO: 3389 - DNA, 670 bp, Homo sapiens
  misc_feature: GYAE6OF01ER0TI.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccacatcaactgcaagtccagccagagtgtttacacaggtaccaacaataagaattacttcgcttggtaccagcaagaaaccaggacagcctacctaagttagctctatttaactcgggcatccgtacccgggacggtcccggggtcccgtcgaccgattcacgcggccaggccgggtctggagacgagtatttcaccgtctccaccactcgagcacgccgtgcgacggctggaaagagtggtaggtacttaagttttatttaaccgtgtacgacgtacgtaacgttaatttacgtaaggttaacgttacccgtaaccgtaggttaccgtttttaccgggggacccgggggtaaccgaacggtcgttacgggaacgtaaccgtaacgtaaaaccggtaacggttagggtacgggtaccgtacggtaccccgaaacccgttacgttacccggtttaagttccccgtttaacgtaacccgtttcccccgg

SEQ ID NO: 3390 - DNA, 595 bp, Homo sapiens
  misc_feature: GYAE6OF01BAHQB.39.31.C09.1.454.CMB.1.raw
  modified_base (441)..(441): a, c, t, g, unknown or other
  misc_feature (441)..(441): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagttgttttacacgtaggtaccaaacaataagtaattacttcgcttggtaccagcaacgaaaccaggacacgacctacctaagttcgacctactatttacgtgggcctacgtccgtaacccggggacggttcccgggtcctacgtacccgtattccgacgtcggcgacggtcgggtcaggacgactagtactttcactcctcaacctatcgagcacgcctgcgagctagaagngtgtagtacttattactagtgtacagtctaagttataagtattcgtactgtacgttacggttcgggaccgggaacaggtcgagataacgtaacgtaaacgtagtgtacggtcgtacgaccctacgtcttacgtccgttcttcgtccttaccccg

SEQ ID NO: 3391 - DNA, 558 bp, Homo sapiens
  misc_feature: GYAE6OF01EKOGC.39.31.C09.1.454.CMB.1.raw
  modified_base (358)..(358): a, c, t, g, unknown or other
  misc_feature (358)..(358): n is a, c, g, or t
  modified_base (550)..(550): a, c, t, g, unknown or other
  misc_feature (550)..(550): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccagacagcctctaagtgctctatttactggcatccgtaccgggagtccggggtccctgaccgattcagcggcagcggtctgagacagtactttcnctcacaccatcagcagcctgcgaggcgtagaagatggtaggtcttaagtttacttactgtcagtcgtaattattatagtacgtcctagtagttacggtttacgggacccggggtacaaggtcgtaggtaacacgttacgaaaacggtcttagggtcggtactcgaccacctactaccttaggttcccttcgngttccccg

SEQ ID NO: 3392 - DNA, 542 bp, Homo sapiens
  misc_feature: GYAE6OF01BEAMP.39.31.C09.1.454.CMB.1.raw
tcagtcgcactagtcacgaccggtgctcgatttagacgtctcatcaaggaaggaaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtcctgaccgattcagcggcagcgggtctgagacagtatttcactctcaccatcagcagcctgcaggctgaagtatggtcgctagtttattactgtcagcagttattatagtacgtcctctagtacgtttcgggaccggggtacgaagtcgtggagtactacgaaaacgacgtcggtaggctcgacctacctacgttcgtacgttaccttctacgttcccttaccccg

SEQ ID NO: 3393 - DNA, 519 bp, Homo sapiens
  misc_feature: GYAE6OF01A3K59.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggactagtttatactgtcagcagttattatagtagtcctcagtacgttttcgggccggggaccgaacgcgtggagatacgaaacgtacgtggtaggcgtcgaccacctactcttgtcttctcgttccc

SEQ ID NO: 3394 - DNA, 543 bp, Homo sapiens
  misc_feature: GYAE6OF01BUO54.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctctaagtgctcattactgggcatcctacccgggagtccgggtccctgaccgattcagcggcaggcgggtctgagacagtatttcactctcaccatcagcagcctgcaggctagaagatgtggctagtttattactgtcagctagttattatagtacgtcctacgagttacgtttcgggaccggggacctaggcgtaggacgtacgtaacgaaacgtaacgtggtacggtctacggacctaccgtacgttcttagttccttccgtacttccccg

SEQ ID NO: 3395 - DNA, 556 bp, Homo sapiens
  misc_feature: GYAE6OF01DESTK.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagacagaaaccaggacagcctctaagttgctctatttacgtggcatccgtacccgggagtcccggggtcctgaccgtatcagcggcagcgggtctgagacagtatttcactctcacatcagcacgcctgacgacggctaggaacgtgtggtcggtactagttttactacgtgtcagtctagttattagtagtacgtcctagtacgttacgtttcgggcccggggtaacaagtcgtaggtagacgtacgaaaaccgtacgtggtacggctacgaccacctattactgttactctcgttacccg

SEQ ID NO: 3396 - DNA, 576 bp, Homo sapiens
  misc_feature: GYAE6OF01CHO3W.39.31.C09.1.454.CMB.1.raw
  modified_base (399)..(399): a, c, t, g, unknown or other
  misc_feature (399)..(399): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaataagaattacttcgcttggtaccagcaagaaaccaggacagcctcctaagtgctcatttactgggcatccgtacccgggagtcccggggtcctggaccgattcgagcggcaggcggtctgagacagtatttcactctcactatcagcacgcctgacaggctagaagntgtggctagtttatacgtgtcagtctagtattatagtacgtcctcgaagttcgttttacggggacccggggtaaccaggtccgtagggtaagacgtacgaaaacgtaaccgttaggtacggtccttacggacccaaccgtacgttccttaggtttaccttccgtacctttcccccgg

SEQ ID NO: 3397 - DNA, 598 bp, Homo sapiens
  misc_feature: GYAE6OF01CJ9ZM.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcagaaaccaggacagcctcctaagttgctcatttacgtgggcatccgtacccggggacggtcccggggttccctggacccgtattccgacggccggacgaggccgggtctggaacgacagtatttcacctctaccaccatcagcacgcctgcgaggtctagaagatggtgacttagtttactacgtgtcgagtctaagttatttagtagttacgtccttacgtacggtttccgttttacgggggacccggggtaaccagggtaccgttgggaagtacgtaaccgaaaacggtacgtaggtcggctacgaccacctatcgttacgttccttctacgttccccg

SEQ ID NO: 3398 - DNA, 586 bp, Homo sapiens
  misc_feature: GYAE6OF01DP03A.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcagaaaccaggacagcctacctaagttgctcatttacgtgggcatccgtacccggggagtcccggggtccctgaccgtattcagccggcagcgggtctgagacagtatttcactctcaccatcagcagcctgcaggctagaagatgtgtctagtttatactgtacagtactagttattatagtacgtcctacgtagttacgttttcggggaccggggtaccgtaggtcgtagggaacgtaacgtaccgaaaacggtaaccgttaggtcgggtcctacggacctaacccgtaacgttcccgttgtttacctttccgtaccgtttacccccg

SEQ ID NO: 3399 - DNA, 544 bp, Homo sapiens
  misc_feature: GYAE6OF01C3LGH.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctactaagttgctctatttactggcatccgtacccgggagtcccggggtccctgaccgtattcagcggcaggcgggtctgagacagtactttcactctcaccatcagcacgcctgcaggctagaagatggtggctagtttattactgtcgagacgtagttattatagtagtcctgtagtacgtttcgggaccgggtacagtcgtaggagtagtacaaacgtacgttggtacggctacgctaacctacttccttagttccttcgtcttaccccg

SEQ ID NO: 3400 - DNA, 596 bp, Homo sapiens
  misc_feature: GYAE6OF01CA35X.39.31.C09.1.454.CMB.1.raw
  modified_base (306)..(306): a, c, t, g, unknown or other
  misc_feature (306)..(306): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagcccagagttgttttacacacggtaccaaacaataagtaattacttcgcttggtaccagcaagaaaccaggacacgcctacctaagttcgctctatttacgnggcatccgtacccgggagtcccggggtccctggaccgattcgacggcggacgaggccgggtcgtagacgactagtactttcactctacacctatcagcacgcctagcaggctagaagtagtggtcgtatagtttacttacgtagtcagtctaagttattagtagttacgtaccttacgacgttacggtttaccggggacccggggtaacgtacgtcggtaggagtacgtaaccgaaacgtacgttaggacggtctacgacctacgtactcgtagttcttctacgttcccg

SEQ ID NO: 3401 - DNA, 566 bp, Homo sapiens
  misc_feature: GYAE6OF01CONJ9.39.31.C09.1.454.CMB.1.raw
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagtgctcatttacnggcatcgtacccgggngtcccggggtccctgaccgattcagcggcagccggtctgacgacagtatttcactctcaccatcagcagcctgcaggctgaacgatgtcggctaagtttactacgtcgtacgagactaagttattagtagttaacgtcctactaggttaccgttttcgggacccggggtaactacgcgtaggacgtagtaccgaaaaccggtacgttggtacggtcgtacgaccctaaccgtattaccttgttccttctaaccgttccccg

SEQ ID NO: 3402 - DNA, 606 bp, Homo sapiens
  misc_feature: GYAE6OF01DHN6D.39.31.C09.1.454.CMB.1.raw
  modified_base (395)..(395): a, c, t, g, unknown or other
  misc_feature (395)..(395): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgttttacacaggtaccaacaaataagaattacttcgcttggtaccagcagaaaccaggacagcctcctaagttgctcatttactgggcatctacccgggagtcccgggtccctgaccgtattcgagcggcaggcggtctgagacagtatttcactctcaccatcagcagcctgcaggctagaagtntgtggtactatttatactggtacagtactaagttaattagttacgtacgtcccttacgtagttaccggttttacggggacccggggttaacaagggccgttaagggaacgtacgttaaaccggaaaaccggtaaacgttcgggttacgggcttacggaccccgtaacccgtaacttccgttacgttcccctttcgtaaccgtttcccccgg

SEQ ID NO: 3403 - DNA, 556 bp, Homo sapiens
  misc_feature: GYAE6OF01AYQGQ.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagtgtttacacaggtaccaacaataagaattactcgcttggaccagcagaaaccaggacagcctactaagttcgctcatttacgnggacagtccgtacccgggagtcccggggtccctgaccgattcgacgcggcacggcgggtctggacgacagtactttcacttctcaccatcagcagtcctgcaggctagaagatgtagtactagtttatactgtcagcaagttatagtagtacgtcctacgtagttacggtttcgggacccggggtaacacggtcgttaggaagtacgtaacgaaacgtacgtgtacggtctacgacaccgtatcgtattcttcgtacttcccg

SEQ ID NO: 3404 - DNA, 612 bp, Homo sapiens
  misc_feature: GYAE6OF01D981C.39.31.C09.1.454.CMB.1.raw
  modified_base (297)..(297): a, c, t, g, unknown or other
  misc_feature (297)..(297): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttacacaggtaccaacaataagaattacttcgcttggtaccagacaagaaaccaggacagcctacctaagttgctactatttacgngggcatcgtacccgggacgtccggggtaccctgaccgattcagcggcagcggtctgacgacagtactttcactcacaccatcagccagctgcacggctagaacgtagttggtaggtacttagttttattacttgtacacgtacgtagttaacttagttagtaacgttccttacgtaacgttaccggttttacggggacccggggtaaccgtaacggtcgtaggaacgtaataaccgtaaaacggtaaccgttagggtcggtacgtaccggcctaacctacgttaccttagtttccgttaccttacgttacccccg

SEQ ID NO: 3405 - DNA, 515 bp, Homo sapiens
  misc_feature: GYAE6OF01A0NT9.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacnggcatctacccgggagtccggggtccctgaccgattcagcggcagcgggtctgagacagatttcactctcaccatcagcagcctgcaggctagaagatgtggctagtttattactgtcagcagttattatagtacgtcctcgagtacgttttgggacccggggtacaggcgtggagagtacgaaacgactggtggctgcaccgattctagttcttcattcccg

SEQ ID NO: 3406 - DNA, 559 bp, Homo sapiens
  misc_feature: GYAE6OF01AWYC8.39.31.C09.1.454.CMB.1.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctctaagttgctcatttacngggcatcctacccgggagtcccggggtccctgaccgattcgagcggcacggcgggtctgagacagtatttcactctcaccatcagcagcctgcaggctagaagtatggtaggactagtttatactgtacagctagttattagtagtacgtcctacgtagtacgtttacgggaccggggtaacctaacggtcgtaggaacgtataccgaaaacggtacgttggtcggtctacggactaccgtatccgttagtcctttcgtacttaccccg

SEQ ID NO: 3407 - DNA, 565 bp, Homo sapiens
  misc_feature: GYAE6OF01D1C8C.39.31.C09.1.454.CMB.1.raw
  modified_base (355)..(355): a, c, t, g, unknown or other
  misc_feature (355)..(355): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacagtccaacaataagaattacttcgcttggtaccagcaagaaaccaggacagcctcctaaagttgctctatttactgggcagtccgtaccccggggagtccggggtccctggaccgattcagccggcacggcgggtcngagacagtatttcactctcacatcagcagcctgcaggctgaagatgtggactagtttatactgtcagctagttaattacgtagttacgtcctagtacgttacgttttcggggacccggggtaacaaggcgttagggagtaacgtaacgaaaaccggtaacgttggtacggtctacggaccaccgtattctacgttcctcgtcttaccccg

SEQ ID NO: 3408 - DNA, 588 bp, Homo sapiens
  misc_feature: GYAE6OF01CU3AA.39.31.C09.1.454.CMB.1.raw
  modified_base (311)..(311): a, c, t, g, unknown or other
  misc_feature (311)..(311): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctctgggcgagagggccaccatcaactgacaagtccagccagtagttgtttacacgaggtaccaacaataagaattacttacgacttaggtaccagacaacgaaaaccaggacacgcctacctaagttcgctactactttacgngggactacgtaccgtacccgggaggtccggggtccctacgaccgtattcgacgacggcaggccggtctaggacgacgagtactttacactctacacatcacgcacgtcctgacgtacggctaggaacgtagtggtggacttagtttagttactgtacactgtaacttattattacggtcgtacctgtacgtaccggtttagggaccggaacgagcgtaggagactacgaaacgtacgtggtgctgacctacgtatccgttagttactctcgttcccg

SEQ ID NO: 3409 - DNA, 512 bp, Homo sapiens
  misc_feature: GYAE6OF01BIFMW.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcctacccgggagtccggggtccctgaccgattcagcggcagcgggtctgagacagatttcactctcaccatcagcagcctgcaggctgaagatgtggctagtttatactgtcagcagttattatagtgtcctctagtacgtttcgggccgggtacaggcgtggagatacgaaacgtacgtgtggctcgcaccgtatctagtcttcgacttcccg

SEQ ID NO: 3410 - DNA, 510 bp, Homo sapiens
  misc_feature: GYAE6OF01BDU6X.39.31.C09.1.454.CMB.1.raw
  modified_base (292)..(292): a, c, t, g, unknown or other
  misc_feature (292)..(292): n is a, c, g, or t
  modified_base (324)..(324): a, c, t, g, unknown or other
  misc_feature (324)..(324): n is a, c, g, or t
  modified_base (387)..(387): a, c, t, g, unknown or other
  misc_feature (387)..(387): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccctggctgtgtctctgggcgagagggccaccatcaactgcaagtccagccagagtgttttacacaggtccaacaataagaattactcgcttggtaccagcagaaaccaggacagcctcctaagttgctcatttacnggcatctacccggagtccggggtcctgaccgnttcagcggcaggcgggtctgagacagatttcactctcaccatcagcagcctgcaggctgaagntggtgctagtttattactgtcagcagttattatagtatcctcagtacgtttcgggaccgggacaggcgtaggacagtacaaacgtacgtgtaggctcgccacgtatctagttctctgttcccg

SEQ ID NO: 3411 - DNA, 599 bp, Homo sapiens
  misc_feature: GYAE6OF01A7U9S.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctactaagtcgctcaattactgggcagtcctacccgggagtcccggggtccctgaccgattcgagcggcacgcgggtctgagacagatttcactctcgaccatcagcagcctgacgaggctagaagatggtacggtacgttaaggtttacttacgtacgtacgtagtacctaagtttattaagttacggttaacgttcccttacgtaacggttaccgttttacggggacccgggggtacctaacggtccgttaagggagtaaactaccgaaaacgtacgtggtacggcgtagtacccaccgtacttctagttccttccgtacttccccg

SEQ ID NO: 3412 - DNA, 527 bp, Homo sapiens
  misc_feature: GYAE6OF01DHSDX.39.31.C09.1.454.CMB.1.raw
  modified_base (513)..(513): a, c, t, g, unknown or other
  misc_feature (513)..(513): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatcgtacccggagtccggggtccctgaccgattcagcggcagcggtctgagacagatttcactctcaccatcagcacgcctgcaggctagaagtatgtggctagtttattacgtgtcagactagtactttatagttactcctactagtctttaggggccggggtaccaggcgtggagtactacgaaacgtaactggtacggctgaccacctatccttnttcttctcttcccg

SEQ ID NO: 3413 - DNA, 552 bp, Homo sapiens
  misc_feature: GYAE6OF01BQ1BU.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctcttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacnggcatctacccgggagtccggggtcctgaccgattcagcggcacggcgggttctgagacagactttcacttctcaccatcagcagcctgcagctagaagatgtggactagtttacttactgtcagtctaagttattagtagtacgtcctacgtagtacgttttcgggacccggggtaccaaggccgtggaagtactaccgaaaacgtaaccgttaggtcggcgtacgaccaccgtatccttagttcttccgtgttccccg

SEQ ID NO: 3414 - DNA, 551 bp, Homo sapiens
  misc_feature: GYAE6OF01A2CTO.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcgtacccgggagtccggggtccctgaccgattcagcggcacggcgggtctgagacagatttcactctcaccatcagcacgcctgcaggctgaagtatggtgactagtttatacgtgtacagactagtattagtagtacgtctactagttacgttttcgggacccggggtaacaaggtcgtaggacgtactaacgaaacgtacgtggtacggtctacgacccacgtacttcgttagttccttcgtagttccccg

SEQ ID NO: 3415 - DNA, 618 bp, Homo sapiens
  misc_feature: GYAE6OF01D8FKH.39.31.C09.1.454.CMB.1.raw
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagacaagaaaccaggacagcctacctaagtgctctatttacgnggctagtccgtacccggggagtcccggggtccctggaccgtattcgagcggcgaggtccgggtctggagaactagtacttttcaccttcaccaccatacagcgacgcctgcgtaggcctagaagtagtggtacgggtctagttttacttactgtctaaggtactagttaagttaagtacggttacgtacccttacgagttaccggttttacggggaccggggtaaccgaggtacgtacgggtagaacttaacgaaacggtaacttgggtacggtaccgtcgaccgtaccgtacgttacttacgttccttcgtacgttccccg

SEQ ID NO: 3416 - DNA, 537 bp, Homo sapiens
  misc_feature: GYAE6OF01A3XDV.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcgtacccgggagtccggggtccctgaccgattcgagcggcaggcgggtctgagacagatttcactctcaccatcagcagcctgcgaggctagaagtatggtggcgtagtttattacgtgtcagctagttattatagtacgtcctcgtagtacgttttcgggacccggggtacagcgtagggatacgtacgaaacgtacgtggtcggctcgccacctactcttagtccttgtcttccccg

SEQ ID NO: 3417 - DNA, 617 bp, Homo sapiens
  misc_feature: GYAE6OF01AB4YI.39.31.C09.1.454.CMB.1.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcattctctgttgctctggatctctggtgcctacgggacatcgtgatgacccagtctccagactccctggctgtgtctctgggcgagagggccaccatcaactgcaagtccagccagagtgtttacacaggtccaacaataagaattacttcgcttggtaccagcagaaccaggacagcctactaagttcgctcatttacgngggcacgtccgtacccgggaggtcccggggtaccctggtaccgattcgaggcggacgacggcggtctgagacgagtatttccacgttctaccgacctatcgaacgccgtagccctgaccgaacgggtctaggaagtacgttggtggtaccgttagtttacttacgtgtcgtaacgacgtagttatttagtaggtacttacccgtctaaggttccggtttaccgggaccgggggtaaccaggtccgtaggtactacgtaacgtaaaccggtacgttggtacggtactcggacccaccgtacttccgtagttcccttcgtacgttcccg

SEQ ID NO: 3418 - DNA, 643 bp, Homo sapiens
  misc_feature: GYAE6OF01EJL7Y.39.31.C09.1.454.CMB.1.raw
  modified_base (302)..(302): a, c, t, g, unknown or other
  misc_feature (302)..(302): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttttacacaggtaccaaacaataagaattacttcgcttggtaccagacaacgaaaccaggacacgcctacctaagtcgaccctatttacngggcacgtccgtacccggggaggtcccggggtccctcgaccgtatcgagccggcaggccggtctgacgacgtagtactttcacttctaccaccgtactcgacgaccacgccctgaccgtaggaccgtaggaacgtagtggtacggtacgttaaggttttaacttaccgtggtactacgtactaaggtttaatttaagtaacgttacgttcccttacgtaacggttaccgttttacggggaccccggggtaacaacggtcgtaggaacgtaataccgaaacgttacgtggtacggtctcggaccactacgttccgtgttacccttctccgttccgtaccccg

SEQ ID NO: 3419 - DNA, 551 bp, Homo sapiens
  misc_feature: GYAE6OF01EHUUA.39.31.C09.1.454.CMB.1.raw
  modified_base (396)..(396): a, c, t, g, unknown or other
  misc_feature (396)..(396): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgctcatttactgggcatccgtacccgggagtccggggtccctgaccgattcagcggcaggcgggtctggagacagtatttcactctcaccatcagcagcctgcaggctagaagntgtgctagtttattacgtgtcagcagttattagtagtacgtcctatacgttacgttttacgggacccggggaaccaaggtcgtagggacgtactaacgaaacggtaacttggtacggctagccaacccgtattccttagtccttcacgttccccg

SEQ ID NO: 3420 - DNA, 555 bp, Homo sapiens
  misc_feature: GYAE6OF01CEJPE.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaaataagaattacttcgcttggtaccagcagaaaccaggacagcctcctaagttgctcatttacnggcatccgtacccgggagtcccggggtccctgaccgattcagcggcagcgggtctgagacagtatttcactctacaccatcagcagctgcaggctagaagatggtggtactagtttattactgtacagctaagttattatagttacgtcctactaggttacgttttgggacccggggaacctagcgtaggaagacgtacaaacggtacgtaggtacggtctcggacctaccgtacttcgtagttccttctaccgttccccg

SEQ ID NO: 3421 - DNA, 577 bp, Homo sapiens
  misc_feature: GYAE6OF01BI1EX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgtttacacaggtccaaacaataagaattacttcgcttggtaccagcaagaaaccaggacagcctacctaagttgctctatttactgggcatccgtacccgggagtcccggggtcctcgaccgattcgagccggcaggcggtctgagacagtactttcgactctcaccatcacgcacgcctgcgaggctagaagtatggtggtcgttagtttattacgtagtcgagtctaagttattaagtagtacgttacctacgtagttacgttttacgggaccggggtaaccaacggtcgtaggacgtacgtaaccgaaacggtacgttggtcggtcgtcgaccaccgtactcgttagttcttcgtcgtccccg

SEQ ID NO: 3422 - DNA, 579 bp, Homo sapiens
  misc_feature: GYAE6OF01ADLEW.39.31.C09.1.454.CMB.1.raw
  modified_base (334)..(334): a, c, t, g, unknown or other
  misc_feature (334)..(334): n is a, c, g, or t
  modified_base (539)..(539): a, c, t, g, unknown or other
  misc_feature (539)..(539): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaacaataagaattacttcgcttaggtaccagcaagaaaccaggacagcctcctaagttgctcatttacgtggcatccgtacccggggagtcccggggtccctgaccgnttcgagcggcaggtcgggtctggagacgagtactttcactctcaccatcagcacgcctgcaggctagaagtagtggtacggacttaagtttacttacgtgtacgagtctaagtttattaagtacgttacgtacctacgtacgttaccggtttcgggacccggggtactaaggccgtaggagaactacgaaacgtacgtggtacgntacgacctaaccgtcttacgtgttaccttctcgttccccg

SEQ ID NO: 3423 - DNA, 763 bp, Homo sapiens
  misc_feature: GYAE6OF01CSJF6.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctcagactccctggctgtgtctcgtgggcgaggacggccacatacaactgacagtccagccaagtagttgtttacaacgacggtaccaaacaaagtaagtaactttacgttcgtacgtttacggaccagacgaaacgaaaccgaggacacgccttacgtaagttcgactacttactttacggcggtactacgttacccggtaccgggtacggtcccggggtaccctaggaaccgtacttcgacggccggacgacgggtccggttacgagaacggtacgtagttactttaccaacttcctaaccaaacctacgtaccgaacgaccgacggttcccgtacggtacgacggtaccgtaaggaaacggtagttgggtacggttacgtttaagttttaacgttacgttcgtacgtagtacgtaagtttaattaagttaacggttacgttacccgttagtaacgggtttaccggtttaaccggggacccggggtaaccgtaacggtacggtacgggtaaacgtaaccgtaaacggtaaaaccggttacggtacggttacggtaccgtacggtaacctaccgttattacccgttagtttcccgttacgttacccgttacccccgg

SEQ ID NO: 3424 - DNA, 565 bp, Homo sapiens
  misc_feature: GYAE6OF01DD324.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccctggctgtgtctctgggcgagagggccaccatcaactgcaagtccagccagagttgttttacacaggtccaacaataaagaattacttcgcttggtaccagacagaaaccaggacagcctctaagtgctctatttacgtggacactccgtacccgggaggtcccggggtcctcggaccgtattcgacggcggcaggccggtcagagacagtatttcactctacaccatacagcacgcctgcaggctagaacgtagtgcggtactagttttatactgtacagtactagttattagtagttaacgtcctagtacgttacgtttcgggaccgggactagtccgtaggagtactacgaaacgtacgttgtacggtcacgtccaactacttacgtgtacctcgtcttaccccg

SEQ ID NO: 3425 - DNA, 560 bp, Homo sapiens
  misc_feature: GYAE6OF01ATD48.39.31.C09.1.454.CMB.1.raw
  modified_base (291)..(291): a, c, t, g, unknown or other
  misc_feature (291)..(291): n is a, c, g, or t
  modified_base (326)..(326): a, c, t, g, unknown or other
  misc_feature (326)..(326): n is a, c, g, or t
  modified_base (369)..(369): a, c, t, g, unknown or other
  misc_feature (369)..(369): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacnggcatcctacccgggagtcccgggtcctgaccgtnttcaggcggcaggcgggtctgagacagtatttcactctcaccntcagcagcctgcgaggctagaagtatggtgacttagtttattacgtgtacagctagttattatagttacgtacctacgtacgttacggttttcgggacccggggtacaacggtcgtaggtaacgacgtaccgaaacggtactggtacggtctacgacctaccctacttcgtgttccttcgtacgttccccg

SEQ ID NO: 3426 - DNA, 603 bp, Homo sapiens
  misc_feature: GYAE6OF01BFRKD.39.31.C09.1.454.CMB.1.raw
  modified_base (295)..(295): a, c, t, g, unknown or other
  misc_feature (295)..(295): n is a, c, g, or t
  modified_base (373)..(373): a, c, t, g, unknown or other
  misc_feature (373)..(373): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaataagaattacttcgcttggtaccagcagaaaccaggacagcctcctaagttgctcatttacgngggcatccgtacccgggagtcccggggtcctggaccgtattcagcggcaggcgggtctgagacgagtatttcacttcncaccatccagcagccctgcgacggcgtagaaagtgtgtggtacttaggtttacttacgtgtacagtactagttaacttagtagttacgttcctacgtaggttaccgttttcggggacccggggtaaccgaaggtacggtagggaacgtacgtaacgaaaacggtacgttaggtagggtccgtaggaccctaaccgtacttaccgttagttccgttccgtaccgttccccg

SEQ ID NO: 3427 - DNA, 568 bp, Homo sapiens
  misc_feature: GYAE6OF01CPX4Q.39.31.C09.1.454.CMB.1.raw
  modified_base (294)..(294): a, c, t, g, unknown or other
  misc_feature (294)..(294): n is a, c, g, or t
  modified_base (558)..(558): a, c, t, g, unknown or other
  misc_feature (558)..(558): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaacaataagaattacttcgcttggtaccagcaagaaaccaggacagcctcctaagttgctcatttacnggcatcctacccgggagtcccggggtcctgaccgattcgagcggcaggcgggtctggacgactagacttttcactctacaccaatcaagcacgcctagcgacggctagaacgtagtggtagtactagtttattacgtgtcagcagttaattaattagttacgtcctcgtaagtacgttttacgggacccgggggtaactacggtcgtaggtacgaactacgaaaacgtaacgtaggttcggcgtcacacctattctagtccttntacgttcccg

SEQ ID NO: 3428 - DNA, 701 bp, Homo sapiens
  misc_feature: GYAE6OF01B4BOH.39.31.C09.1.454.CMB.1.raw
tcagtcgcactagtcacgaccggtgctcgatttagacgtctcatcaaggaaggaagggggcagcaagatggtgttgcagacccaggtcttcatttctctcgttgctctggatctctggtgcctacggggacatcgtgatgacccagtctccagactccctggctgtgtctcgtgggcgagacgggccaccatcaactgacaagtccgagcctaaggagttgtttaacacgtacggtacccaaacgaaataaagtaactttaacttcgtacttgggtaaccaggaccaagaaacccaggacacggtccctacgtaaagttcgaccttacgtaacttttaaccggtgggactacgttccgtaacccggggagttcccggggtcctagaaccgtattcgacgtcggacaggcggtactgacgactagtactttcgactcgtacaaccctagaccagaccacgtccctagaccgaggtctaaggaacgtagtccgggtagtaacttaagttttacgtactggtaacctaagtctaagttattaagtagtaccgtttccaagtacgttttaaccgggtttcgggaacccggggttaatacgacggttacgggaaataccgtaaccgaaacggttaacgtcggttacggcctaggacccaaacgggttacctttcggtaccgtttacccttcgaacctttcccccgg

SEQ ID NO: 3429 - DNA, 586 bp, Homo sapiens
  misc_feature: GYAE6OF01BI1QV.39.31.C09.1.454.CMB.1.raw
  modified_base (297)..(297): a, c, t, g, unknown or other
  misc_feature (297)..(297): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (384)..(384): a, c, t, g, unknown or other
  misc_feature (384)..(384): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaacaataagaattacttcgcttggtaccagacaagaaaccaggacacgcctacctaagttgctcatttacnggcactcgtacccgggaggtcccggggtccctgaccgtattcagcggcncggcgggtcngacgacagtactttcacttctacaccgntcagcagcctgcaggctagaagagtgtggacttagtttattactgtcagtctagttattacttagtacgttcctacgtaggttacggttttcggggaccggggtacgtacggtcgtaggtacgtacgtaaccggtaaacgtaccgttagggtcggtcgtacgacctaccgtacgttacttagttccttcgttccgttccccg

SEQ ID NO: 3430 - DNA, 505 bp, Homo sapiens
  misc_feature: GYAE6OF01BJ3XW.39.31.C09.1.454.CMB.1.raw
  modified_base (499)..(499): a, c, t, g, unknown or other
  misc_feature (499)..(499): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtacttttgggccgggggaccaaggctggagatcaaaacgtactgtggctgcaccatctgttcttcnttcccg

SEQ ID NO: 3431 - DNA, 727 bp, Homo sapiens
  misc_feature: GYAE6OF01DLJIY.39.31.C09.1.454.CMB.1.raw
  modified_base (309)..(309): a, c, t, g, unknown or other
  misc_feature (309)..(309): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagactccctggctgtgtctcgtgggcgaggagggcccaccatcaactgacaacgtccagccagagttgtttacacacggtaccaaacaataagtaattacttcgcttaggtaccagacaagaaaccaggacagcctactaagttgctactatttacgngggactacgtaccggtacccggggacggtcccggggtccctacgaccgtacttcgaacggccggacgaggtccgggttacgtaggaacgacgtaacggtacttttaccaccttacctaccaaccgtactaccgaacggccaacggtccctaggacccgaagggtacctaggaaacggttagtcgggtacggtacttaaggtttttacttaccgtagtaccgtaacggtacgttaaggtttaaactttaaggtaacggttaaccttccgtacgttagggttttaaccggttttcgggggaaccggggtaacctaagggcgttaagggtaactaccgttaaacgaaacggttacgttgggtacggtccgtagtacccaaaccgttagttccgttacgtttacccttcgcccgtttccccg

SEQ ID NO: 3432 - DNA, 568 bp, Homo sapiens
  misc_feature: GYAE6OF01AL4AF.39.31.C09.1.454.CMB.1.raw
  modified_base (289)..(289): a, c, t, g, unknown or other
  misc_feature (289)..(289): n is a, c, g, or t
  modified_base (426)..(426): a, c, t, g, unknown or other
  misc_feature (426)..(426): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaccaggacagcctctaagtgctcatttacngggcatccgtacccgggagtccggggtccctgaccgattcgagcggcagcgggtctgagacagtactttcactctacaccatccagcagcctgcagctagagatgcgctagtttactacgtgtcagctagttattanagttacgtcctacgagttaccgtttcgggccggggtaaccacggtcgtagggagtaaacgtaccgaaaaccggtacgttaggtcggtccgttagaccctaacccgtacttaccgttagttccctttactaccgtttcccccg

SEQ ID NO: 3433 - DNA, 821 bp, Homo sapiens
  misc_feature: GYAE6OF01DAGD6.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctggctgtgtctcgtgggcgaggacgggccaccatccaaacgtgaccaacggtccagccagtagttagttttacacgaggtaccaacaaataagaattacgttcgtacgttaggtaccagacagaaaccgaggactacgcctacctaagttgacttactaactttacgtcggactaactccggtaaccccggggtaagggttccccggggttacccctacggtaaccccgtaacgtttaccgaacggtccgggaccgtaaacgggccgggggtttacaggggaaaccggtaaccgtaacggttaacttttacccgaacctttaccgtaaccctaaacccaacgttacgaaaccggaccgttaaccggcccgttacggaacccgtagggtaccgtaacgggtaaacggtaggttagggtacgggtaaccgttaaggttttaaccgtttaaccgtaggttaccgaacggttaccgtaagtttaagtttaacgttaacggtaacgttacccgttacgtaacggtttaccggttttaccgggggaccggggtaaccctaaggtaccggtagggtaagtacctaaacgtaaaccggtacgttacggacggtccgtacgaccctaacctaacggttactacggtttaccctttaccgcgtttacccccg

SEQ ID NO: 3434 - DNA, 516 bp, Homo sapiens
  misc_feature: GYAE6OF01C7RX8.39.31.C09.1.454.CMB.1.raw
  modified_base (296)..(296): a, c, t, g, unknown or other
  misc_feature (296)..(296): n is a, c, g, or t
  modified_base (372)..(372): a, c, t, g, unknown or other
  misc_feature (372)..(372): n is a, c, g, or t
  modified_base (408)..(408): a, c, t, g, unknown or other
  misc_feature (408)..(408): n is a, c, g, or t
  modified_base (469)..(469): a, c, t, g, unknown or other
  misc_feature (469)..(469): n is a, c, g, or t
  modified_base (510)..(510): a, c, t, g, unknown or other
  misc_feature (510)..(510): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaaactgcaagtccagccagagtgttttacacaggtccaacaataagaattacttcgcttggtaccagcagaaaacccaggaacagcctcctaagttgctcatttacnggcatctacccgggagtccgggtcctgaccgattcagcggcagcgggtctgagacagatttcactctcaccatcancagcctgcagctgaagatgtgactagtttatacgtntcagctagtacttatagtacgtacctacagtctttcgggcgggtaaccgagtcgtggtaanatacgaaacgaacgtgtggctagccactactactgtctctnttcccg

SEQ ID NO: 3435 - DNA, 658 bp, Homo sapiens
  misc_feature: GYAE6OF01C3NOW.39.31.C09.1.454.CMB.1.raw
  modified_base (299)..(299): a, c, t, g, unknown or other
  misc_feature (299)..(299): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaataagaattacttcgcttaggtaccagcaagaaaccaggacagcctacctaagttgctcatttacgnggcactccgtacccgggaggtcccggggtcctggaccgtattcgacgcggcaggccggtctgagacagtactttcactctacacctatcgagcacgtccgtgaccgaggtccttaggaaagtagttggtacggtactttaaggttttacttaaccgttggttaccgaagtaccgttaaggttatttaacgttaaggttaaccgttcccttacgtaacggtttaccggttttacgggggacccgggggtaacctaggtccggttaggaacgtacgtaaccgtaaaacggtacgttaggtcggtaccgtacgtaccaaccgtacgttaccgttaggtttcccttcgtaccgtttacccccg

SEQ ID NO: 3436 - DNA, 553 bp, Homo sapiens
  misc_feature: GYAE6OF01BWWSX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctcatttacgtggcagtccgtacccgggagtcccggggtccctgaccgtattcgagcggcaggcggtctgagacagtatttcactctacacctatcagcacgcctgcgaggactagaacgagtgtggtactaggtttacttacgtgtacagcagttattatagttactcctacgtagttaccgtttgggacccggggtacaagcgtaggaagtactacgaaacgtacgtgacggctcgaccacgtactcttgttcttccgtacgttcccg

SEQ ID NO: 3437 - DNA, 819 bp, Homo sapiens
  misc_feature: GYAE6OF01CNC2A.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcggtgatcgacccagtcctccagacctcccgtggctgtgtctcgtgggcgaggacggcccaccatcaactgacaacgtccagccagtagttgtttaccacgaggtaacccaaataaataaagtaacttacgttcgcgttacggaaccagacgaacgaaaccgacggacacgtacctacgtaagtcgtctactaacgtttacgcggactacgtacccggtacccggggtaccggttcccggggtaccctacggtacccgtagttccgacggtaccgggaccgtacgggtccggggtctaggaacgtaacgtaagttactttacccaccgttacctaacccgtaacctaacgtaccgaagaccgtaaccggtccgtcggaaccggtaaggtaccgtaaggtaaagtaggttacgggtaacggtacgttttaaggttttaactacggtacgtaacgtacgtaacgtttaaaggtttaatttaacgttacggttaacgttacccgttaacggtaaccggggttttacccgggttaacccgggggaacccggggtaaccgtaacgggttccggaaaggtaacgtaaaccgtaaacccggtaaaacgggtaccggttagggtacggtccggttaccgaacccgtaacgttaccgtttcgttacccggtttcttaacccgttacccgtcccccg

SEQ ID NO: 3438 - DNA, 562 bp, Homo sapiens
  misc_feature: GYAE6OF01D4S1I.39.31.C09.1.454.CMB.1.raw
  modified_base (393)..(393): a, c, t, g, unknown or other
  misc_feature (393)..(393): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctctatttactgggcatcgtacccgggagtcccggggtcctgaccgattcagcggcaggcggtctgagacagtactttcactctcaccatcagcagcctgcaggctgaagntgtgactagtttatactgtacagctagttattagtagtaacgtcctacgtagtacgttttcgggacccggggtaccaaggcgtacgggaagtactaccgaaaacggtaacgttggtacggtcctacgaccaaccgtacgttaccgttgttaccttcgaacgttcccccg

SEQ ID NO: 3439 - DNA, 633 bp, Homo sapiens
  misc_feature: GYAE6OF01BORF1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtccaacaataagaattactcgcttggtaccagacacgaaaccaggacacgcctctaagttgctactatttacgcggactacgtccgtacccgggagttcccggggtccctggaccgtatcgagcggcacggccgggtctagacgactagtactttccgacttctacacctatacacgtcacgtccctgacgaggtctaggaagtagtacggtcggtacgtaagttttacttacgtgtacgagtacgtaagttaattagttacggttacgtacccttcgtaacgttaccgttttacggggacccggggtaaccgtaacggtcggtaggacgtaacgtaaccgtaaaacggtaccgtaggtacggtcgtacgacccaccgtactacgttgttaccttccgttacgttcccccg

SEQ ID NO: 3440 - DNA, 603 bp, Homo sapiens
  misc_feature: GYAE6OF01C5W6D.39.31.C09.1.454.CMB.1.raw
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatgacccagtctccagactccctggctgtgtctcgtgggcgagagggccaccatcaactgacaacgtccagaccaggagttacgttttaacacacggtaccaaactaaataacgtaattactcgacgttggtaaccagacaagaaaccaggacacgcctactaaggtnctctattacgnggcactcgtacccggagtcccgggtctgaccgtntcgacgcggcagcggtnaganacagtcttacnctctacactanctagcagtctcgacgagacgtagaacgtagtgtagtactagtttacttacgtgtactagtactagttattaagtacgttactacgtacgtacgttacggtttacgggaccgggtacgacggtacgtaggtacgacgtaacgaaaccgtacgtaggcggtcgtaccgaccgtaccgtacgttacttagttacccttaccgtaccgttaccccg

SEQ ID NO: 3441 - DNA, 607 bp, Homo sapiens
  misc_feature: GYAE6OF01ENLAT.39.31.C09.1.454.CMB.1.raw
  modified_base (296)..(296): a, c, t, g, unknown or other
  misc_feature (296)..(296): n is a, c, g, or t
  modified_base (412)..(412): a, c, t, g, unknown or other
  misc_feature (412)..(412): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagaggccaccatcaactgcaagtccagccagagtgtttacacaggtaccaaacaataagaattacttcgcttggtaccagacaagaaaccagacagcctactaagtcgcctatttacgnggcactccgtacccgggagtcccggggtccctggaccgtattcgaggcggtacgaggcgggtctagagacagtactttacactcctacaccatcagcacgcctgcaggctagaagngtgtgactagtttactacgtgtcagtactaagttacttagtacgtacttccgtacgtacgttacggtttccggggaccggggtaaccaggtaccgtagggaacgtaacgtaaccgtaaacggtacgttggtacggtaccgtggaccctaaccgtagttccgtacgtttacccgttctaccgttccccgtaccccg

SEQ ID NO: 3442 - DNA, 544 bp, Homo sapiens
  misc_feature: GYAE6OF01CNIZR.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacgtgggcatccgtacccgggagtcccggggtccctgaccgattcagcggcaggcgggtctgacgacagatttcactctaccaccatcacgcacgcctgcaggctagaagtatggtggctagttttatactgtacgagctagttattagtagttacgtcctgtagttacgttttcgggacccgggtacagcgtaggacgtacgtacgaaacgtacgtggtacggctacgcacctatcttgtccttgtacttcccg

SEQ ID NO: 3443 - DNA, 587 bp, Homo sapiens
  misc_feature: GYAE6OF01CM61F.39.31.C09.1.454.CMB.1.raw
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (360)..(360): a, c, t, g, unknown or other
  misc_feature (360)..(360): n is a, c, g, or t
  modified_base (580)..(580): a, c, t, g, unknown or other
  misc_feature (580)..(580): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcggacccagtcctccagacctccctggctgtgtctcgtgggcgaggacgggcccaccatcaactgacaagtccagccagtacgttgtttacacgaggtaccaacaataagattactcgcttaggtaccagcaagaaccnggaacagcctctaagtgctactattacgnggcncgtccgacccggtgtcccgggtcctgaccgtatcgagcggacaggtcggtntggaagactagtactttcacctcacaccatcacgtcacgtccgtgaccgaggcctagaagtagtcggtacgacttaagtttactacgttgacctagtctaaggttattacgtaggttctaccgttagtacggttaccggtttcgggaccgggtaactagtcggtaggacgtataccgaaacgtcgtagcgtacgtctaccactcgtctacgtctcccgtnttccccg

SEQ ID NO: 3444 - DNA, 667 bp, Homo sapiens
  misc_feature: GYAE6OF01CJT6D.39.31.C09.1.454.CMB.1.raw
  modified_base (235)..(235): a, c, t, g, unknown or other
  misc_feature (235)..(235): n is a, c, g, or t
  modified_base (303)..(303): a, c, t, g, unknown or other
  misc_feature (303)..(303): n is a, c, g, or t
  modified_base (380)..(380): a, c, t, g, unknown or other
  misc_feature (380)..(380): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagacctcccgtggctgtgtctcgtgggcgagacggcccaccatccaactgcaagtccagccagagttgttttacacaggtaccaaanaataagaattactcgcttcggacagcaagaaaccaggacagcctacctaagttcgctactatttacgnggcagtccgtacccgggcgtcccggggtccctaggacccgtattccgaggccggacacggtccgggtctggaacganacggtactttcgacttcctaccaaccgtagtccgtacgaccgacgtcccgtggaccgtacggcgtaaggtaacgtacgtgggtacggtaccttaaggttttacgttaccgttgtacgtacgtacgtaagttacttaagttacgtaccgtaccgtacgtacggtttaccggttttacggggacccgggtaactaaccgggtcgtagggtacgacgtaaccgaaacggtcgtaggtaccggcgtaccgtacgacccgtagttccgttagtccttccgtaccgttccccg

SEQ ID NO: 3445 - DNA, 651 bp, Homo sapiens
  misc_feature: GYAE6OF01AMQLP.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagtgctcatttactggcatccgtacccgggtcgtcccgggtccctgaccgattcagcggtcaggccggtctagagacgagtactttccactctaccaaccatccgacgaccacgtaccctgaccgtaggcctaaggaaacgtagttcgggtacgggtaccttaaggtttttaacttaccgttacgtccgtaaggtacctaagtttaatttacgttaacgttacgttcccttacgtaacgttaccggttttccggggaaccggggtaaccaacggtcggttaagggacgtaaccgttaccgaaaaccggtaacgttggtacggccgttacgaccaaccgtacttccgttacgttccgttcctccgtttaccccg

SEQ ID NO: 3446 - DNA, 524 bp, Homo sapiens
  misc_feature: GYAE6OF01BXUWM.39.31.C09.1.454.CMB.1.raw
  modified_base (477)..(477): a, c, t, g, unknown or other
  misc_feature (477)..(477): n is a, c, g, or t
  modified_base (501)..(501): a, c, t, g, unknown or other
  misc_feature (501)..(501): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgatccagtctccagactccctggctgtgtctctgggcgagagggccaccatcaactgcaagtccagccagagtgttttacacaggtccaaacaataagaattacttcgcttggtaccagcagaaaccaggacagcctctaagttgctcatttactgggcatcgtacccgggagtcccggggtccctgaccgattcagcggcacgcgggtctgagacagtatttcactctcaccatcagcagcctgcaggctgaagagtgtggactagtttattagtgtcagctaattattatagtactccgtagtaagttccgtttgggaccgggtacaaggcgtggaanacgtacgaaacgtacgtggtcgcngaccaccatactcgtcttctacg

SEQ ID NO: 3447 - DNA, 582 bp, Homo sapiens
  misc_feature: GYAE6OF01B74RJ.39.31.C09.1.454.CMB.1.raw
  modified_base (408)..(408): a, c, t, g, unknown or other
  misc_feature (408)..(408): n is a, c, g, or t
  modified_base (496)..(496): a, c, t, g, unknown or other
  misc_feature (496)..(496): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattactcgcttggtaccagcaagaaacccaggacacgcctcctaagttgctcatttactgggcatccgtaccccggggaggtcccggggtccctggaccgattcgagcggcacggtcgggtctggagacagtactttcactctcacctatcagcagcctgcaggctagaagtntggtggtacttagtttattactgtacgagtctaagttattagtacgtacttccctacgtacggttacgtttcggggacccggggtaanacggtacgtcggtaaacgtcgtaaaccgaaacggtacgttggtaggtctcgaccacgtaattcgtagttacttcgtaacgttcccg

SEQ ID NO: 3448 - DNA, 617 bp, Homo sapiens
  misc_feature: GYAE6OF01C8NFL.39.31.C09.1.454.CMB.1.raw
  modified_base (300)..(300): a, c, t, g, unknown or other
  misc_feature (300)..(300): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (438)..(438): a, c, t, g, unknown or other
  misc_feature (438)..(438): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagaattacttcgtcttggtaccagcagaaaccaggacacgcctacctaagttgctctattttacgnggtcactccgtacccgggacggtcccggggtccctggaccgtacttcgacggcggtcaggcgggtctgagaacagtactttcgactctaccaccatcagcacgctgcaggctagaagngtgngtactagtttatactntgagctaagttattagtagttaacgtccgtactacgggttacgtttacggggcccggggtaaccagggtcgtagggaacgtaacgttaccgaaaaccggtacgttgggtacggtaccgttacggtacccaaccctacggtttacccttaggtttacccttccgtaccgtttaccccccg

SEQ ID NO: 3449 - DNA, 715 bp, Homo sapiens
  misc_feature: GYAE6OF01EAW55.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaatttacttcgcttaggtaccagcaagaaccaggacacgtcctactaagtgctctactttacgngggactacgtaccgtacccggggacggttcccgggtccctggaaccgtcttcgacgtcggcacggtccggtcaggacgacagttactttacgaccttcgtaccacctactaccgagtccgaacgtcccgaggacgacgggtactaaggaaggtgttggacggttacttaagttttaccttacggttacgtacgacgtacgtaacgtttaatttacgtaacggttctacccttacggtacggttttacgggtttaccgggggaacccggggtaactacgggtccggtaacgggtaacgtaaccgttaaaccggtaaaaccggtaacggttggggttacccggtacggttaccgtaacccggtaacccgtttaccgtccgtttaccggttacccgtttccgtaccgtttacccccccgg

SEQ ID NO: 3450 - DNA, 553 bp, Homo sapiens
  misc_feature: GYAE6OF01CQ24A.39.31.C09.1.454.CMB.1.raw
  modified_base (389)..(389): a, c, t, g, unknown or other
  misc_feature (389)..(389): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagaggccaccatcaactgcaagtccagccagagttgttttacacaggtccaacaataagaattacttcgcttggtaccagcagaaaccaggacagcctcctaagtgctcatttactggcatccgtacccgggagtccggggtccctgaccgattcagcggcaggcgggtctgagacagtatttcactctcacatcagcagcctgcaggctgaagntgtggctagtttattacgtgtcagctagtattatagtaacgttcctcgtaagtcgttttagggccggggtaaccctaggccgtaggacgaagttaccgaaaacggtaactggtacggcttacgactaaccgtattacctggtttcccttacgtctttaccccgg

SEQ ID NO: 3451 - DNA, 728 bp, Homo sapiens
  misc_feature: GYAE6OF01B3C67.39.31.C09.1.454.CMB.1.raw
  modified_base (301)..(301): a, c, t, g, unknown or other
  misc_feature (301)..(301): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttgtttacacgaggtaccaacaataagtaattacttcgcttggtaccagacaagaaaccaggacagcctcctaagttgctctatttacgngggactatccgtacccgggaggtcccgggtcctagaccgtattcaggcggcgaggcgggtctaggacgacgagtactttccaacttcctacaacctataccgacgtaccaacggtcccgtacgacggtaacggaccgttaaggaaacgtacgttgggtacgggtaccgtttaaggtttttaacgtttaaccgttcggtaaccgtaacggtacgttaaagtttaagtttaacgttacggttaaccgttacccttacggttaacggtttaccggttttaccgggggacccggggtaaccgtaacggtacggtacgggtaaacgtacgtaaaccggtaaaacggtaacggttaggtaccgggtacctacggtaacccgtaacccgttacgttaccgttacgtttacccttaacgttcccgtttacccccg

SEQ ID NO: 3452 - DNA, 534 bp, Homo sapiens
  misc_feature: GYAE6OF01ARJXD.39.31.C09.1.454.CMB.1.raw
  modified_base (340)..(340): a, c, t, g, unknown or other
  misc_feature (340)..(340): n is a, c, g, or t
  modified_base (513)..(513): a, c, t, g, unknown or other
  misc_feature (513)..(513): n is a, c, g, or t
tcagtcgcactagtcacgaccggtgctcgatttagacgtctcatcaaggaaggaaggggcagcaagatggtgttgcagacccaggtacttcatttctctgttgctctggatctctggtgcctacggggacatcgtgatgacccagtctccagactccctggctgtgtctctgggcgagagggccaccatcaactgcaagtccagccgagagtgttttacacaggttccaacaataagaattacttcgcttggtaccaggcagaaaccaggacagcctcctaagtgctcattactgggcatctacccgggagtccggggtccctgaccgattcagcgcagnggtctgagtacagatttcaactctacgaccatcagcagcctgccaggctgacgatgtgctagtttatacgtgtcagcagtattatagtatcctgtagtacgtttgggacccggggtaccaaggtccgtgggataacgtaccgaaagtacctggtacggccttcgccctaactntcgttactcttcagttccccg

SEQ ID NO: 3453 - DNA, 533 bp, Homo sapiens
  misc_feature: GYAE6OF01COS9F.39.31.C09.1.454.CMB.1.raw
  modified_base (437)..(437): a, c, t, g, unknown or other
  misc_feature (437)..(437): n is a, c, g, or t
  modified_base (518)..(518): a, c, t, g, unknown or other
  misc_feature (518)..(518): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaaccaggacagcctctaaagttgcccatttactgggcatctacccgggagtccggggtccctgaccgattcagcggcaggcggtctgagacagtatttcactctcaccatcagcagcctgcaggctgaagatgtgctaagtttattactgtcagcagttattataagtagtcctanagtacgtttggccggggaaccaagcgtaggagatacgaaacgtaacgtggtagcgtcgaccgaccattctacgttcttacncttccgttacccccg

SEQ ID NO: 3454 - DNA, 586 bp, Homo sapiens
  misc_feature: GYAE6OF01DU8M7.39.31.C09.1.454.CMB.1.raw
  modified_base (301)..(301): a, c, t, g, unknown or other
  misc_feature (301)..(301): n is a, c, g, or t
  modified_base (358)..(358): a, c, t, g, unknown or other
  misc_feature (358)..(358): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtaccaacaataaagaattacttcgcttggtaaccagacaagaaaaccaggacaagcctacctaaagttgctctatttacngggcaatcgtaccgggagtccggggtcctgaccgtattcagcgcaggcgggtctganacagatttcaactctcaccatcagcacgctgcgacggactgaaagtataggtggctaagtttactttacgtgttacagactaagtaatttaactagtaacgtcctacgtacgtacgttttgggacccggggtaacgagcgttaggaagactaacgaaaaccggtaacgtacggtacggtactaggaccaacccgtacttaccttagttacctttacacgtttaccccg

SEQ ID NO: 3455 - DNA, 569 bp, Homo sapiens
  misc_feature: GYAE6OF01C4R2Z.39.31.C09.1.454.CMB.1.raw
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaaacaataagaattacttcgcttggtaccagcagaaaccaggacagcctcctaagttgctctatttacgnggcatccgtacccgggagtcccggggtccctgaccgattcagcggcaggcgggtctgagacagatttcactctcacctatcagcagcctgcaggctagaagtatggtggtactagtttattacgtgtacagtactagttatttataggttactccttacgtagttaccgttttggggacccggggtacaggtcgtagggaacgacgtaaccgaaaacgtacgtaggtcggcgtacggacctaccgtacttcttgttcctctacgtttcccccg

SEQ ID NO: 3456 - DNA, 682 bp, Homo sapiens
  misc_feature: GYAE6OF01D7RHV.39.31.C09.1.454.CMB.1.raw
  modified_base (300)..(300): a, c, t, g, unknown or other
  misc_feature (300)..(300): n is a, c, g, or t
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgttttacacaggtaccaaacaataagaattactcgcttggtaccagacaagaaaccaggacagcctactaagttgctctatttacgngggcattccgtacccgggcggtcccggggtccctgtaccgtattcgaggcggcgacggtcgggtctgacgacagtatttcactcctacacctatcagccacgtccgtgaccgaggactaggaagtagtggtcggtacgttagttttaattacgtacgtacgtacggtactaagttaactttaagtacgttaccgttacccgtttacgtaacgggtttaccggttttaccggggggacccggggtaacctaagggtcggttaacgggaacgtaaccgttaaaccggtaaaaccggttaccgttagggttacggtccgtacgggtacccttaacccggttactttacccgttagtttaccctttcccgtaccctttacccccgg

SEQ ID NO: 3457 - DNA, 604 bp, Homo sapiens
  misc_feature: GYAE6OF01BK6Y4.39.31.C09.1.454.CMB.1.raw
  modified_base (381)..(381): a, c, t, g, unknown or other
  misc_feature (381)..(381): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagagtgttttacacaggtccaaacaataaagaattacttcgcttggtaccagacaagaaaaccgaggacagcctacctaaagttcgctctatttacgtggctatccgtacccgggacgtcccgggtcctcgaccgattcgagcggcgaggcggtctgagacagtatttcactcncacatcagcagcctgcgagctggaagacgtgtaggtactagtttactactcgtcagtactaggttattagtagtacgttcctagacggtttacgtttacgggacccggggtaacaacggtcgtagggaaatacgtaaaccgtaaaacggtaccggttaggtcgggtacctacggaccctaaccttacggttaccgttagttcccttaacgtctttacccccgg

SEQ ID NO: 3458 - DNA, 720 bp, Homo sapiens
  misc_feature: GYAE6OF01AY9XD.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagaggccaccatcaactgacaagtccagcctagagttgttttacacaggtaccaaacaataagaattacttcgcttggtaccagacaagaaaccaggaccagccctacctaagttcgctactatttacgtgggctacgtccgtacccggggacgtcccggggtcctacggacccgtattccgaggtccggacgacggtccgggtctaggaacgtacgtagtactttaccaccgttacctaccaacccgtaacttaccgaacgtaccgaacgtcccgtaggaccgtaacgggtctagggtaaacgtacgtttacggtacgggtacctttaaacggtttttacttaacggttcgttaccgtaacgtccgtttaaacgttttacgtttaaaccgttaaggtttaacccgttacccgtttacggtaacggtttaccggttttacggggacccggggtaaccaaggtccggtagggtaacgtaactaccgaaaacgtcgtaggtacggtctagaccctacgtattccgtagtttcctccgtcttccccg

SEQ ID NO: 3459 - DNA, 621 bp, Homo sapiens
  misc_feature: GYAE6OF01AU45I.39.31.C09.1.454.CMB.1.raw
  modified_base (313)..(313): a, c, t, g, unknown or other
  misc_feature (313)..(313): n is a, c, g, or t
  modified_base (425)..(425): a, c, t, g, unknown or other
  misc_feature (425)..(425): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctggtgtctcgtgggcgagagggccaccatcaactgcaacgtccagccagtagttgtttacacgaggtaccaaacaaataagaactttacgttcgacttcggtaccagcaagaaaccaggacacgcctacctaagttcgactactatttacgngggactactaccgtacccggggagtcccggggtccctgaccgtattcgacggcggcgacggcgggtctggacgacagtactttccgactctacaccatcgagcacgctgacnggctaggatagtcgtgtacttagtttacttacgtgacgagtctaagttattaagtaggttactactacgtacggttacggtttcggggacccgggtaacctaggtcgtagggtaactacgtaaccgtaaacggtacgtgggttcggccttacgccgtaaccctacgtttcgtacgtttaccttcgtaccttccccg

SEQ ID NO: 3460 - DNA, 578 bp, Homo sapiens
  misc_feature: GYAE6OF01B8363.39.31.C09.1.454.CMB.1.raw
  modified_base (295)..(295): a, c, t, g, unknown or other
  misc_feature (295)..(295): n is a, c, g, or t
  modified_base (459)..(459): a, c, t, g, unknown or other
  misc_feature (459)..(459): n is a, c, g, or t
  modified_base (559)..(559): a, c, t, g, unknown or other
  misc_feature (559)..(559): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaacaaataagaattacttcgcttggtaccagacagaaaccaggacagcctcctaagttgctcatttacgngggcactccgtacccggggaggttcccggggtccctggaccgtattcgacggccggcacggtcggggtctagaacgacagtatttccactcctacacctatcgagcagcctggacaggctaagaagtagtggtaggacttaaggtttacttacgtgtacgagtntagttaattagtacgttagttccctacgtagttaccggtttcgggacccggggaactaggcgttaggagtactaacgaaacgtagtgtggctcgacactntacttgtcttcacttcccg

SEQ ID NO: 3461 - DNA, 833 bp, Homo sapiens
  misc_feature: GYAE6OF01AFZW2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagacgggccacatcaactgcaagtccagccagtagtgttttacacacggtaccaacaataagaactttacttcgtcgttaggtaccagacaagaaacccgaggaccaacgtccttaccttaagttcgtactcttaacgttttaccgtcggggactacgttacccggttaccccggggtacgggttccccggggttccccgtcgtaaacccggtatttaccggaacggtccgggaccgtacggggtccggggttacctacgggaaacgtaaccggaacggtttaacgtttttccccgaaaaccttcccgtaacccgtaaacccaccgtttaaccggaccggaccgtaaccggttccccggtcggacccggtaacgggtaccgtaacggtaacggtaaaggttcggttacggacgtttaacggttttaacgttacgttacggtaccgtacggtaccttaaggtttaacgtttaagttaacggttaccttacccgtaggttaccgttacggggttttaccggggccgggggtaacctaacgggtcgtaaccggacgtaacggttaaacccgaaacgggtacgttacgggttacggaccgttaccgaccgttaaacccgtcttaaccggtttcggttaaccctttccgtacgtttacccccg

SEQ ID NO: 3462 - DNA, 535 bp, Homo sapiens
  misc_feature: GYAE6OF01BLEJT.39.31.C09.1.454.CMB.1.raw
  modified_base (292)..(292): a, c, t, g, unknown or other
  misc_feature (292)..(292): n is a, c, g, or t
  modified_base (354)..(354): a, c, t, g, unknown or other
  misc_feature (354)..(354): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcctacccgggagtccggggtccctgaccgattcagcggcagcgggtctgagacagntttcactctcacatcagcagcctgcaggctgaagatggtggactagtttatactgtcagctagttaattatagttacgtcctacgtagtacgttttgggacccggggtacaaggcgtagggagagtacgaaaacgtacgtggtggctagccaaccgtattccgttagtcttctacttcccg

SEQ ID NO: 3463 - DNA, 601 bp, Homo sapiens
  misc_feature: GYAE6OF01BDIZU.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacacgcctcctaagttgctctatttacgtggcagtccgtacccggggtagtcccggggtccctgacccgattcaggcgcgaggcggtactgaagacacgtatttcactctacaccgatcagcacgcctgcaggcagagatgtgcttagttacttactgtacagtacaagtttattagtaggttactacccgttagtacggttaccgttttagggggcccggggtaacctacgtcggtaggacgtaacctaacgaaaacccggttagtggttcggacctacggtccctaaacccggttcttaccgtttggttaccctttccgtaactttccccccg

SEQ ID NO: 3464 - DNA, 549 bp, Homo sapiens
  misc_feature: GYAE6OF01C8JEQ.39.31.C09.1.454.CMB.1.raw
  modified_base (298)..(298): a, c, t, g, unknown or other
  misc_feature (298)..(298): n is a, c, g, or t
  modified_base (493)..(493): a, c, t, g, unknown or other
  misc_feature (493)..(493): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgtttacacaggtccaacaataagaattacttcgcttggtaccagcagaaaccaggacagacctcctaagttgctactaatttacgngggctatccgtacccgggagtcccgggtccctgacccgtattcgagcggacaggcggtctagagacagtactttcactctacaccatcagcagcctgctaggctagaacgtatgtagcttagttacttactgtacagactagttattagtagtagtcctacgtagtacgtttcgggaccgggtacagcgtagganacgtacgaaacgtacgtagtaggctacgacacgtattactagtcctcacgttcccg

SEQ ID NO: 3465 - DNA, 805 bp, Homo sapiens
  misc_feature: GYAE6OF01DI2WD.39.31.C09.1.454.CMB.1.raw
  modified_base (719)..(719): a, c, t, g, unknown or other
  misc_feature (719)..(719): n is a, c, g, or t
  modified_base (753)..(753): a, c, t, g, unknown or other
  misc_feature (753)..(753): n is a, c, g, or t
  modified_base (777)..(777): a, c, t, g, unknown or other
  misc_feature (777)..(777): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctcccgtggctgtgtctcgtgggcgaggacgggccaccatcaaacgtgaccaagtccgagaccagtagttcgtttacaacgtacggtaacccaaataaagtaaacgtaactttaaccttcggtcctttaggaacccaagacgaacgaaaaccgaaggaccaacgtcccgttaaccgttaagttcgtaccttaccttaagtttaaccggtacgggtacctaaccggtttacccgtaaccccggggtacgggttccccggggttaccctacggtaaccgtaagttaccgacgggaccggacgtaaccgggtccggggttactagggaaacgtaaccgtaaggttaccctttacctaacccttccgtaacccaacccttaagaccgaacgacgaacccgtaccgtcggaaccgtacgggtaccgtaaggtaacggtaagttcggtaaggtaccggttaagtttttacgtacgttacgttaacgaacggttaccgttaagtaacgtttagtaacgttacgtccttaacgtacggttacggtttaccggggaccggggtaactacggngtaacggtagtaacgtaaaccgaaacggtaacgngggtactacgacgtaccaacgttntaccttagtaccttcgtccgttaccccg

SEQ ID NO: 3466 - DNA, 547 bp, Homo sapiens
  misc_feature: GYAE6OF01DTM0Q.39.31.C09.1.454.CMB.1.raw
  modified_base (403)..(403): a, c, t, g, unknown or other
  misc_feature (403)..(403): n is a, c, g, or t
  modified_base (531)..(531): a, c, t, g, unknown or other
  misc_feature (531)..(531): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggaacacgcctacctaagttgctctatttactgggcatccgtacccgggaggtcccggggtccctggaccgtattcagcggcaggcggtctgagacagtatttcactctcaccatcagcacgcctgcaggctagaagtntggtgactagtttatactgtcagctagtattatagtacgttctacgtagttacgtttcggggaccgggaacctaggtcgtaggatactacgaaaacgtagttgtcggtctcgactaccgtattacgtnttcctcgtcttccccg

SEQ ID NO: 3467 - DNA, 644 bp, Homo sapiens
  misc_feature: GYAE6OF01DDPA1.39.31.C09.1.454.CMB.1.raw
  modified_base (234)..(234): a, c, t, g, unknown or other
  misc_feature (234)..(234): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgcctacggggacatcgtgatcgacccagtctccagactccctggctgtgtctcgtgggcgagacgggccacatacaactgcaagtccagccagagttgtttacacacggtaccaanaataagaattacttcgcttaggtaccagacaacgaaaccaggacagcctaccgtaagtcgacttactattttacgcggactacgtcccggtacccgggacggttcccggggtccctggaccgtattcgacggtcggcagggtccgggtatgaagacagtactttccgacttctacacactcacgcacgcctgacgaggctaggaagtgttaggtacggacttaagtttactacgtcgtacagtactaagttatttacgtacgtttacctaccgttacgtaaccgtttacggtttacgggaaccggtaacggggtaaccctaggtccggtagggacgtacgtccggaacgtaacggtacgtgggttacggtcgtaccgtacctaccgttattccggttacgttcttacccg

SEQ ID NO: 3468 - DNA, 598 bp, Homo sapiens
  misc_feature: GYAE6OF01E261R.39.31.C09.1.454.CMB.1.raw
  modified_base (435)..(435): a, c, t, g, unknown or other
  misc_feature (435)..(435): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttgtaccagcagaaaccaggacagcctctaagttgctactatttactgggcatccgtacccgggagtccggggtccctgaccgattcgagccggcaggcggtctgacgacagtatttcactcctacaccatcagcacgcctcgcgaggctagaagtagtaggtggtacgttagtttacttacgttcgtanacgtactaagttacttagtaagttacgtcctactacggttacgttttacgggaccggggtaacgtaacggtacgtaggacgtacgtaacgtaaacggtaacgtagggtacggtccgtacgaccgtaaccgtacttacgttacgttccttcgtacgttaccccg

SEQ ID NO: 3469 - DNA, 787 bp, Homo sapiens
  misc_feature: GYAE6OF01DFCX9.39.31.C09.1.454.CMB.1.raw
  modified_base (120)..(120): a, c, t, g, unknown or other
  misc_feature (120)..(120): n is a, c, g, or t
tcagtcgcactagtcacgaccggtgctcgatttagacgtctcatcaaggaaggaaggggcagcaagatggtgttgcagacccaggtccttcatttctctgttgctctggatctctggtcnccgtacggggacattcgtgatacgacccagtctccagcctcctggctgtgtctcgtgggcgagacggaccacatcaactgacaacgtccagcctagtacgttacgtttacacgaacgtaccaaacgtaataacgtaactttacgttcgacttacggaccaagaccaacgaaaccaggacacgtcctactaagttcgacttacgtaactttacgtcggaccgtaacggtaccccggggttacccggtaccgggttaccccgggtacccgttacggaccggtacttacggaacggtccgggtacgtacgggccggttaccaggtaacgtaacctaacggttacttttacccgaaccgttaccctaaccgaaaccccgtagttacccggaaacggtccgaaccggtacccgttcggaacggtaacggtacgtagggtaaacgtagtttacgggttacgtacgtttaagttacccgttaagtcgtacgtagtactaagtttaacttacgtacgttaacgtgttaccggtacggttaacggtttccggggaaccgggtaacaacggtcgtaaggaacgtacgtaaaccggtaacgtccgttaggttacggacctacggtaacctacccgttaacgttaccgttacgtcccttaccgtcccgtttaaccccgg

SEQ ID NO: 3470 - DNA, 594 bp, Homo sapiens
  misc_feature: GYAE6OF01BWMIC.39.31.C09.1.454.CMB.1.raw
  modified_base (297)..(297): a, c, t, g, unknown or other
  misc_feature (297)..(297): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaacaataagaattacttcgcttggtaccagacaagaaaccaggacagcctacctaagttgctctatttacgnggcatccgtacccgggagtcccgggtcctgaccgtattcgagcgcaggcggtctgacgacagtacgtttcacttcctacaccatcaagtcacgcctgcgaggcgtagaagtagtggtagacgttagtttacttacgtgtcgagtactaagttacttaagtagtacgttcctagtacgttacggtttacggggacccggggtaacctaggcgtaggaacgtactaacgaaacggtaacgttggtacggtccgtacggtaccaccgtacttccttacgttctttccgcgtttacccccg

SEQ ID NO: 3471 - DNA, 543 bp, Homo sapiens
  misc_feature: GYAE6OF01BM755.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacnggcatctacccgggagtcccggggtccctgaccgattcagcgcagcgggtctgagacagatttcactctcaccatcagcagcctgcagctagaagatgtgctagtttatactgtacagctagttattagtagtagtacctcgagttacgtttcgggaccggggtaccgaagcgtaggaacgtagtaccgtaaaacgacgtaggtacggcgtagacccacgtacttacttacgttccttcgtacttaccccg

SEQ ID NO: 3472 - DNA, 628 bp, Homo sapiens
  misc_feature: GYAE6OF01EPZRC.39.31.C09.1.454.CMB.1.raw
  modified_base (316)..(316): a, c, t, g, unknown or other
  misc_feature (316)..(316): n is a, c, g, or t
  modified_base (599)..(599): a, c, t, g, unknown or other
  misc_feature (599)..(599): n is a, c, g, or t
  modified_base (617)..(617): a, c, t, g, unknown or other
  misc_feature (617)..(617): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgagagggccaccatcaactgcaacgtccagccagtagttgttttaacacgacggtaccaaacaaataagtaatttacttcgtcttaggtaaccagacaacgaaaccaggacagcctacctaagtcgctactatttacgnggctagtccgtacccgggtacgtcccgggtcctagaccgtatcgagcgcaggcggtctagacacgtagtactttcacttccacaccatcagcacgtccgtgacgtaggctaaggaagtattcgggacggttacttaagtttacttaacgtgtactaggtctaaagtttattaagtaaggttccgtccctaggtaacggtttacggtttcgggggaacccgggaactaaggtcgtaggtaacgactaaccgaaaacgtcgtagacggtctacgacctaaccgtnttacccgtattccttccncgtttcccccg

SEQ ID NO: 3473 - DNA, 593 bp, Homo sapiens
  misc_feature: GYAE6OF01AOGT4.39.31.C09.1.454.CMB.1.raw
  modified_base (292)..(292): a, c, t, g, unknown or other
  misc_feature (292)..(292): n is a, c, g, or t
  modified_base (328)..(328): a, c, t, g, unknown or other
  misc_feature (328)..(328): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctctaagtgctcatttacgnggcagtcctacccgggagtcccgggtccctgaccgnttcgagcggcagcgggtctgagacagtatttcactctacaccatcagcacgcctgcgacggctaggaagacgtggtacggtacgttaagttttacttacgttgtacgagtcgtaagttattaagttagtacgttccgtacgtaggttaccggttttcgggacccgggtaaccgtaggtaccgtagggagtaacgtaaccgaaacggtacgttaggtcggtcgtcgaccaacctacgttacttacggttccttcgtcgttcccccg

SEQ ID NO: 3474 - DNA, 522 bp, Homo sapiens
  misc_feature: GYAE6OF01C7V63.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagtaattacttcgcttggtaccagcagaaaccaggacagcctcctaagttgctctatttactggcatcgtacccgggagtccgggtcctgaccgattcagcgcagcggtctgagacagtatttcactctcaccatcagcacgcctgcaggctgaagtagtgtggtactagtttattactgtcgagtcagttattatagtacgtcctactagtacgtttcgggccgggtacaggctaggatatacgaaacgtacgtgtacggctacgcacctatctagttctcgtcttcccg

SEQ ID NO: 3475 - DNA, 515 bp, Homo sapiens
  misc_feature: GYAE6OF01ASGAN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttactggcatctacccgggagtccggggtcctgaccgattcagcggcagcggtctgagacagtatttcactctcaccatcagcagcctgcaggctagaagatgtggctagtttattactgtacagctagtattatagtacgtcctcgtagtacgtttcgggaccgggtacgagcgtggagactacgaaacgtactgtcggctagccactactctgtccttctcttcccg

SEQ ID NO: 3476 - DNA, 583 bp, Homo sapiens
  misc_feature: GYAE6OF01BBKIK.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctacctaagttgctcatttactgggcatccgtacccgggagtcccggggtccctgaccgattcgagcggcaggcggtctgagacagtatttcactctccaccatcagtcagcctgccgaggctaggaagatgtggcgtagtttacgttactgtcagtcgtaagttactttaatagttacgttccttacgtacgttacggttttacggggacccgggggtaacctaaggcgtaggacggtaactaccgaaaaccggtacgttaggtcggcgttacgcctaaccgtacttcgttagttccttctacgttccccg

SEQ ID NO: 3477 - DNA, 534 bp, Homo sapiens
  misc_feature: GYAE6OF01BU6L3.39.31.C09.1.454.CMB.1.raw
  modified_base (297)..(297): a, c, t, g, unknown or other
  misc_feature (297)..(297): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (402)..(402): a, c, t, g, unknown or other
  misc_feature (402)..(402): n is a, c, g, or t
  modified_base (447)..(447): a, c, t, g, unknown or other
  misc_feature (447)..(447): n is a, c, g, or t
  modified_base (505)..(505): a, c, t, g, unknown or other
  misc_feature (505)..(505): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagcctccctggctgtgtctcgtgggcgagacgggccaccatcaactgcaagtccagccagagtgtttacacaggtacaaacaataagaattacttcgcttggtaccagcaagaaaccaggacagcctctaagttcgctcatttacgnggcatcgtacccgggtagtcccgggtccctagacccgtattcgagcggcaggcgggtcagacgacagtactttcgactntacacatcancngcctgcagctgaantcgtggactagttactactgtacagctaagtatatacgtgtcctnagtacgtttggaccgggtaacagctggaactacgtacgaaacgtacgtggacgcgttnacctacgtacttcagtcttcgcttacccg

SEQ ID NO: 3478 - DNA, 777 bp, Homo sapiens
  misc_feature: GYAE6OF01EA2Q6.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctcccgtggcctgtgtctcgtgggcgaggacggccaccatcaactgacaacgtccagccagtagttgtttaccacgtacggtacccaaataaagtaaagtaactttaccgttcgtacgtttcggtaaccagacaaacgaaaccgaggaccacgtcccttaccgttaagttcgaccttacttacgtttaccgcgggtacctaccggttcccggtaccccgggggtaccggttccccgggtacccgttacggacccgttacgttccggacgggtccgggaccgtacgggtcgggttacacggtaacggtaacgtacggttactttccgaaccttcccgtaaccacctacgttcgaaccgtccgtaccgtaccgtcgaccgtaacggtccgttaaggtaacgtggttacgggttacggttacgtttaaggttttaaccttgtcggtaacgtacgtacgttagtttaattacgtaggttccgtacgttacgaacggttttaccgggttccggggaacccggtagtaacgttcggaaaggtaccgtacgtaacccggtaaacgtcgggttacgacggtccgacgtacccgtacgttcgttactacgttctttaccgccctttcccg

SEQ ID NO: 3479 - DNA, 597 bp, Homo sapiens
  misc_feature: GYAE6OF01DXB46.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttacacgaggtaccaacaataagaattacttcgtcttggtaccagacaagaaaccaggacagcctactaagtgctctatttacgnggactactccgtacccgggtacggtcccggggtcctgaaccgtatcgacgccggtgacggtcgggtctggacgaacagttaacttcaacctctaccacatcgagcagcctgcaggctagaacgtatcggagtacttagtttactacgtcgtacagtcctaagtacttagtagtactctacgtagtacgtttgggacccgggtacacgcgtaggaacgtacgtaacgtaaaccggtattggacggtcctacggaccctaaccgtacgttactacggtttcccttacgtcgtttacccccg

SEQ ID NO: 3480 - DNA, 556 bp, Homo sapiens
  misc_feature: GYAE6OF01B8RH2.39.31.C09.1.454.CMB.1.raw
  modified_base (291)..(291): a, c, t, g, unknown or other
  misc_feature (291)..(291): n is a, c, g, or t
  modified_base (393)..(393): a, c, t, g, unknown or other
  misc_feature (393)..(393): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagttcgctcatttacnggcatccgtacccgggagtccgggtccctgaccgattcagcggcgaggcggtctgagacagtatttcactctacaccatcagcacgcctgcaggctagaagngtgtaggtctagtttatactgtcagtctagttattatagtacgtctacgtagttacgtttacggggaccgggtacaggtcgtagggaatacgtaaccgaaacggtaccgtggtacggtcaccgacctaccgtacttccgttagttccttcgtacgttcccccg

SEQ ID NO: 3481 - DNA, 608 bp, Homo sapiens
  misc_feature: GYAE6OF01CHBSZ.39.31.C09.1.454.CMB.1.raw
  modified_base (310)..(310): a, c, t, g, unknown or other
  misc_feature (310)..(310): n is a, c, g, or t
  modified_base (587)..(587): a, c, t, g, unknown or other
  misc_feature (587)..(587): n is a, c, g, or t
  modified_base (599)..(599): a, c, t, g, unknown or other
  misc_feature (599)..(599): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgagacgggccaccatcaactgcaagtccagccagagttgtttaacactaggtaccaaacaaataagtaattacttcgtcttggtaccagacaacgaaaccaggacagcctacctaagttcgctctatttacgnggacacgtccgtacccgggacggttcccggggtaccctaggacccgtagttcgacggccgggacacggtccgggtactggaacgtacagtactttcaccttcctaccacctatcgaagccgacgtcctggaccagggtactaggaaacgtgttgtggtacttagtttattacgtgctagctaagttataagttcgtactcctagtacggttacgtttcggggaccggtaactaggccgtggaactactacgaaacgtgtggtcgctacgctaccgtntcttgtccttcncgttccccg

SEQ ID NO: 3482 - DNA, 641 bp, Homo sapiens
  misc_feature: GYAE6OF01B19JX.39.31.C09.1.454.CMB.1.raw
  modified_base (306)..(306): a, c, t, g, unknown or other
  misc_feature (306)..(306): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgtttacacaggtaccaaacaataaagtaattacttcgcttacggtaccagcaagaaaccaggaacagcctacctaaggttcgctctatttacgnggactatccgtacccgggagtcccggggtcctgaccgattcgagcggcacggcgggtctagacgacgagtactttccaccttcctacacctactacgacgtaccacgcccgtgacggtacggtcctaggaacgtagtacggtacggtacgttaggttttattacgtgtacacgtcgtagttaatttagtagttcgtaccgtacgtacggttaccggtttacggggacccgggggactaacggtcgtaggtacgtaaacgtaacgaaaacggtacgtggtcggtacgtcgtaccgtaacccgtagttaccgttacttcctttcgaccgtttccccg

SEQ ID NO: 3483 - DNA, 541 bp, Homo sapiens
  misc_feature: GYAE6OF01ARZRR.39.31.C09.1.454.CMB.1.raw
  modified_base (534)..(534): a, c, t, g, unknown or other
  misc_feature (534)..(534): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacgaggtaccaacaataagaattacttcgcttggtaccagcaagaaaccaggacagcctcctaagttgctcatttacgtgggcatctacccgggagtcccggggtccctgaccgattccagcggcagcgggtctgagacagatttcactctcaccatcagcacgcctgcgaggcctagaagatgtggtactagtttattactgtcagctagttattagtagtacgtcctacgagttacgttttcggggacccggggtacacgcgtaggagtactacgaaacgtactggtaggctcgacacctattactgtcttcgtnttccccg

SEQ ID NO: 3484 - DNA, 577 bp, Homo sapiens
  misc_feature: GYAE6OF01ETTAZ.39.31.C09.1.454.CMB.1.raw
  modified_base (404)..(404): a, c, t, g, unknown or other
  misc_feature (404)..(404): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacagcctacctaagttcgctctatttactgggcactccgtacccgggtagtcccggggtccctggacccgtattcagccggcacggccgggtctgagacagtatttcactctcaccatcagcagcctgcagctgaagntgtgctagtttattcgtgtcagctagttattagtagtacgttacctcgtaacggttaccggttttcggggacccggggtaacctaacggtcgtagggtaacgtacgtaaccgaaacgtacggttagcgggtctacggacaaccgtattccgttagttccttctcgttaccccg

SEQ ID NO: 3485 - DNA, 540 bp, Homo sapiens
  misc_feature: GYAE6OF01BC22R.39.31.C09.1.454.CMB.1.raw
  modified_base (533)..(533): a, c, t, g, unknown or other
  misc_feature (533)..(533): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccctggctgtgtctctgggcgagagggccaccatcaactgcaagtccagccagagttgttttacacaggtccaacaataagaattacttcgcttggtaccagcagaaaccaggacagcctcctaagttgctcatttactggcatctacccgggagtccggggtccctgaccgattcagcggcagcgggtctgagacagatttcactctccaccatcagtcacgcctgcagctgaacgatgtggctagtttattctgtacagtcagttattattagtacgtccttctacgtacgttttacgggccggggtaaccgagtcgtggagtactacgaaaccgtacgtaggtcggcgttagccacctactcgttagttcttctnttccccg

SEQ ID NO: 3486 - DNA, 529 bp, Homo sapiens
  misc_feature: GYAE6OF01A6FEA.39.31.C09.1.454.CMB.1.raw
  modified_base (292)..(292): a, c, t, g, unknown or other
  misc_feature (292)..(292): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (386)..(386): a, c, t, g, unknown or other
  misc_feature (386)..(386): n is a, c, g, or t
  modified_base (469)..(469): a, c, t, g, unknown or other
  misc_feature (469)..(469): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctacctaagttgctcatttacnggcatctacccgggagtccgggtcctgaccgattcgagcggcagcggtctgagacagatttcactctcacatcagnanctgcagctgaagctgngtctagttattactgtcagtacagtattatagtatacctcgaagtacgtttggaccggggacaagtcgtaacggagacgttanaaaacggaactgggtacgtgtactccgaacctaagtccttagttccttcgtaattccccg

SEQ ID NO: 3487 - DNA, 582 bp, Homo sapiens
  misc_feature: GYAE6OF01CZITU.39.31.C09.1.454.CMB.1.raw
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
  modified_base (358)..(358): a, c, t, g, unknown or other
  misc_feature (358)..(358): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactcccgtggctgtgtctcgtgggcgagagggccaccatcaaactgcaagtccagccagagttgttttaacacgaggtaccaaacgaataaagaattacttcgcttggtaaccagacaagaaaccaggacagcctctaagttgctcatttacnggacatcgtacccgggagtccgggtccngaccgtattcagcgacacggcggttcngagacagtatttcactctcactatcagcagcctgcagactagaagagtgtagtacttagtttaacttacgtcgtacaggtactaagttattaagttagtaacgtccttaagtacgttacgtttcgggaccgggtacagtacggtaggacgtacgtacgaaacgtacgttggtacggtcgtacgacccgtaactacttacgttattccttcgtccgtttaccccg

SEQ ID NO: 3488 - DNA, 592 bp, Homo sapiens
  misc_feature: GYAE6OF01DGG3W.39.31.C09.1.454.CMB.1.raw
  modified_base (229)..(229): a, c, t, g, unknown or other
  misc_feature (229)..(229): n is a, c, g, or t
  modified_base (445)..(445): a, c, t, g, unknown or other
  misc_feature (445)..(445): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaanaataagaattactcgtcttggtaaccagacaagaaaaccaggacagcctacctaagttgctctatttacgtggcatcgacccgggacgtcccgggtccctgaccgtattcgagccggcgacggtcgggtctaggacgtaacgagtatttcactctcaccagtcagcacgcctgacgagactacgaagagtgtggtactagtttattaacttgtacngacgtagtaattattagttacgtacttacgttaacgtacgttttacggggcccgggtaaccgagtcgtacggagtacgtaacgaaaccgtaaacgtaggtacggtcgtacgaccgacctacttactgttaccttcgtccttaccccg

SEQ ID NO: 3489 - DNA, 604 bp, Homo sapiens
  misc_feature: GYAE6OF01B0NUG.39.31.C09.1.454.CMB.1.raw
  modified_base (297)..(297): a, c, t, g, unknown or other
  misc_feature (297)..(297): n is a, c, g, or t
  modified_base (582)..(582): a, c, t, g, unknown or other
  misc_feature (582)..(582): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccagccagagttgtttacacaggtccaaacaataagaattacttcgcttggtaccagacaagaaaccaggacagcctactaagttgctctatttacgnggactagtccgtacccgggacggtcccggggtccctcggaccgtattcgaggccggacgacggccggggtctggagacgagtactttcgactctacaccatcagcacgcctagcgaggctagaagtagtgtacggtcttaggtttacttacgtagtacacgtacgtaagtttattaagtacggttacgttccctacgttacggtttaccggttttcggggacccggggtactaagtcggtagggactagtaacgaaacgtacgtggcggtcgtacgactaccgtnttcgtctccttacgcttccccg

SEQ ID NO: 3490 - DNA, 645 bp, Homo sapiens
  misc_feature: GYAE6OF01C2FNL.39.31.C09.1.454.CMB.1.raw
  modified_base (372)..(372): a, c, t, g, unknown or other
  misc_feature (372)..(372): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgcaagtccagccagagttgttttacacaggtaccaaacaataagaattacttcgtcttggtaccagacaagaaaccaggacacgcctacctaagttgctactatttactgggcactccgtaccccggggacgtcccggggtcctcggaccgtattcgaggccggcgaggccgggtntgaagacgagtactttcactctacacctatcagcacgtcctgcgaggctagagagtggtagtactagtttactagtcgtacgagtactaaggttactttaagtacgttaacgttccctagttaaccggttacgttttccgggggaacccggggtaacctaggtacggtacgggtaacgtaaaccgtaaccggtaaaaccggtaaccgttgggtacggtaccgttcgaacccaaccgtacttaccgttcgttaccttccggtccttacccccgg

SEQ ID NO: 3491 - DNA, 587 bp, Homo sapiens
  misc_feature: GYAE6OF01EBJFX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagaattacttcgcttggtaccagcagaaaccaggacagcctcctaagttgctcatttactgggcatccgtacccgggagtcccggggtccctgaccgattcagcggcaggcgggtctgagacagtatttcactctcaccatcagcagcctgcaggctagaagatgtggactagtttattactgtcagctaagttatttagtagttacgttcctacgtagttaccggttttacggggacccgggggtaacctaacgggcgttagggaacgtaacgtaaccgaaaacggtaacgttaggttacggcgttcgacctaacccgtacttacctgtttcccttctaccgtttacccccg

SEQ ID NO: 3492 - DNA, 525 bp, Homo sapiens
  misc_feature: GYAE6OF01DFKRD.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcagaaaccaggacagcctcctaagttgctctatttacgtggcatcgtacccgggagtccggggtccctgaccgattcagcggcagcggtctgagacagtatttcactctcacatcagcagctgcagctagaagatgtgactagtttattctgtcagtcgtagttattatagtactcctagtacgtacgttttcgggaccgggtacacgcgtaggagtactacgaaacgtacgtgtggctagaccacctattctgttctcgtacttcccg

SEQ ID NO: 3493 - DNA, 568 bp, Homo sapiens
  misc_feature: GYAE6OF01A2B1W.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaacaataagaattacttcgcttggtaccagcagaaaccaggacagcctcctaagttcgctcatttacnggcatccgtacccgggagtcccggggtccctgaccgtattcagcggcaggcgggtctgaagacagtatttcactctcaccatcagcacgcctgcaggctagaaacgtgtggtcggtacttagttttagtacgtgtacgaagtaagttattaagtaagttacgtccgtagtacggtttacggtttaccggggaccgggtaacaggtcgagagtactaccgaaacgtacgtggtagcgtcgactactagtcctcgttcttacctcttcccgtcccg

SEQ ID NO: 3494 - DNA, 549 bp, Homo sapiens
  misc_feature: GYAE6OF01AC81L.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcaagaaccaggacagcctcctaagtcgctcatttactgggcatccgtacccgggaggtcccggggtccctgaccgattcagcggcagcgggtctgagacagatttcactctccaccatcagcacgcctgcaggtctgaagatggtgcttaagtttatactgtacagctagtattatagtgtcctagtacgttacggtttcgggaccgggtacaggccgtaggataactacgaaacgtacgttggtacggccgttacgacctaccgtattacccttgttccttactcgttaccccg

SEQ ID NO: 3495 - DNA, 543 bp, Homo sapiens
  misc_feature: GYAE6OF01BC2TJ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcaggcgggtctgagacagatttcactctacaccatcagcagcctgcaggctgaagatgtggctagtttattacgtgtcgagctagtaattagtagtagtacctcgtagtacgttttcgggaccggggtaaccaggcgtaggacgtagtaaccgaaacgtacgtaggtaggccgtagaccacctagtccttgttccttctacgttccccg

SEQ ID NO: 3496 - DNA, 635 bp, Homo sapiens
  misc_feature: GYAE6OF01C4NWV.39.31.C09.1.454.CMB.1.raw
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
tcagtcgcactagtcacgaccggtgctcgatttagacgtctcatcaaggaaggaaggggcagcaagatggtgttgcagacccaggtcttcatttctctgttgctctggattctctggtgcctacggggacatcgtgatgacccagtctccagactccctggctgtgtctctgggcgagaggccacatcaactgacaagtccagccagagttgtttacacaggtaccaacaataaagaattacttacgcttggtaccagacaagaaaccaggaacagcctactaagttcgctacgtatttacgnggacagtccgtacccgggagtcccgggtccnggaccgtatcagcggcaggcggtcagacgacgtagtactttcgactcctacaccatcgaagccaacgtcctaggacgaggtacctaggaaagtagttacggtaggtacgttaagttttacttaacgtgttacacgtacgtaagttattaagttacggttacgtacctacgtaagttaccggttttacggggacccggggttaaccaggtacggtaggtaagaacgttaaccgaaaacgtacgttgggtacgtcgtacgaccctaaccgtacttccgttaggttccttacgtctttaccccg

SEQ ID NO: 3497 - DNA, 610 bp, Homo sapiens
  misc_feature: GYAE6OF01BUFPZ.39.31.C09.1.454.CMB.1.raw
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagaattacttcgcttggtaccagcaagaaaccaggacagcctcctaagttgctcatttacnggcatccgtacccgggngtccgggtccctgaccgtattcgagcggcgagcggtctgagacagtatttcactctcaccatcagcagcctgcagctagaagatgtggactagtttattacgtgtactagcgtagttaattaagtacgttacgtaccttacgtaacggttaccggttttacggggaccccggggtaaccaacgggtcgtacgggaacgtaacgtaaaccgaaaacggtaaccgttacggttacgggtccttacggaccctaacccgtacgttaccgttagtttaccctttaccgtacgtttacccccg

SEQ ID NO: 3498 - DNA, 610 bp, Homo sapiens
  misc_feature: GYAE6OF01DGHLW.39.31.C09.1.454.CMB.1.raw
  modified_base (327)..(327): a, c, t, g, unknown or other
  misc_feature (327)..(327): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttttacacaggtaccaacaataagaattacttcgcttggtaaccagacagaaaccaggacagcctcctaagttgctcatttactgggcatcgtacccgggaggtcccggggtccngaccgattcagcggcacggcggtctgagacagtatttcactctcaccatcgagcacgctagcaggctaggaagagtgtaggctagtttatttacgttcgtcgtacgactagttaagtttaattacgtaacggttccttaccgtacggttaacggtttttcggggacccgggggtaaccgtaacgtcgtagggtacgaagtaacctaaaccgggaaactgggttggtcccgtaggtacccaacccggtaacttccgtttacgttccttcttaacccgttccccg

SEQ ID NO: 3499 - DNA, 577 bp, Homo sapiens
  misc_feature: GYAE6OF01A7I9F.39.31.C09.1.454.CMB.1.raw
  modified_base (542)..(542): a, c, t, g, unknown or other
  misc_feature (542)..(542): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctacctaagttgctcatttactgggcatcgtacccgggagtccgggtccctgaccgattcgagcggcaggcggtctggagacgagtactttcgacttctacacctatcacgcacgcctcgacacggctagaagagtcggtcggtacttagtttacttacgtagtacgagtcgtaagttattagtagtacgttaccgtcgtagttacgttttcggggacccgggtacaacggtcgtagggagtacgtaaccgaaacgtacgtggtacggtcncgaccaccgtacgtctacgttcttcgtcgttcccg

SEQ ID NO: 3500 - DNA, 666 bp, Homo sapiens
  misc_feature: GYAE6OF01B5GHF.39.31.C09.1.454.CMB.1.raw
  modified_base (324)..(324): a, c, t, g, unknown or other
  misc_feature (324)..(324): n is a, c, g, or t
  modified_base (385)..(385): a, c, t, g, unknown or other
  misc_feature (385)..(385): n is a, c, g, or t
  modified_base (434)..(434): a, c, t, g, unknown or other
  misc_feature (434)..(434): n is a, c, g, or t
  modified_base (616)..(616): a, c, t, g, unknown or other
  misc_feature (616)..(616): n is a, c, g, or t
  modified_base (653)..(653): a, c, t, g, unknown or other
  misc_feature (653)..(653): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtgatcgacccagtcctccagacctcccgtggctgtcgtctcgtgggcgaggacggccaccatcaactgacaacgtccagcctagtagttagtttaacacgacggtaccaaacaaataagtaatttactcgtacgttacggacagacaacgaaacacggacacgtcctacgttagtcgctattattacgnggactacgtaccgtaccgggtcggtcccgggttccaggtaccgtagtccgacggcggacgngggtccggtctggaacgactacgttacttccgtacctcctaccaacgtntacgacgtccacgtcctggacgaggacgtaaggaagtcgttaggtacgtacgtttagtttactacgtcgagtaacgtattaagtttattaaaccgtcgttacgaccttaacggtacggtttccggggttccgggaacccggtaacgtagcgtaagtacgtaaactaaccggaaagttccggngtaccgtctacgaccctacgttctacgttactttccncgttacgtccccg

SEQ ID NO: 3501 - DNA, 625 bp, Homo sapiens
  misc_feature: GYAE6OF01DOZ8G.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgttttacacaggtccaacaataagaattacttcgcttggtaccagcagaacacgagacacgtcctaacgtagtctctattactcggcgactaccgacccggaacggtccgggtcccggtcgtaccgactacgtacgacggcgacggacggtcgtcgtagacacgtagtttactaccgtactcctaccaactctacgcgacgccgtcgcgacggtacgtagtaaacgagtgtggtactagtttaattacttcgtacgagactagttaattagttacgtaagttcctacgtaagttacgttttacgggaccggggaaccgtacgcggtacggagaacgttaccgaaaacggtaaacgtaggtggtccgtacgtaccgacccgtaacttaccgtgttaacctttccgtactttaccccg

SEQ ID NO: 3502 - DNA, 728 bp, Homo sapiens
  misc_feature: GYAE6OF01DMV7E.39.31.C09.1.454.CMB.1.raw
  modified_base (289)..(289): a, c, t, g, unknown or other
  misc_feature (289)..(289): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccacatcaactgcaagccagccagagttgtttacacaggtaccaaacaataaagaattactcgcttaggtacccagacaacgaaaccaggacagcctacctaagttnctctatttacgtggactatccgtaccccggggaggtcccgggtccctcgaaccgtacttccgagccggcgacggcgggttacgtaggaacgacaggtacttttcaccttcctaccaacctactaccagtcccagtccttcggacgtacgggtacctagggaaaactgttacgggtaggttaccttaaggtttttactacctttagtactaacggtacttagttaactttacggttaagttaccgttacccgtacgttacggtttaccgggttttacccgggggaaccgggggttaaccacgggttaacccgtagggtaaacgtaaccgttaaccgtaaaaacccgggttaacgttggttaccgggcccttaaacgggaccctaaacccgttagtttacccgtttaggtttacccctttcccttaaccgtttccccccgg

SEQ ID NO: 3503 - DNA, 641 bp, Homo sapiens
  misc_feature: GYAE6OF01C6IZH.39.31.C09.1.454.CMB.1.raw
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (381)..(381): a, c, t, g, unknown or other
  misc_feature (381)..(381): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgaggacgggcccaccatacaactgacaacgtccacgccagtagttgttttaacacgacgtaccaaacaaataagtaattaccgttcgtacgttacggtaccagaccaagaaaccaggacacgcctactagtcnctactattacgnggacactccggaccggacggtccgggtccncgaccgtntcgagcgcaggcggtcaganacgtagtacttcactctaccacactcacgacacggtcctaggcgaggacgtagaacgtgttcggtagtacttaagtttactacgtgtacagtactagtttattacgttagtccgttactacggtaacggtttccggttaccggggacccgggtaactaggtacggtaagggtaactacgtaaaccgaaacgttcggtaggttaccggctacgaccctaacgttacttacgttcgttacccttccggtaccttacccccgg

SEQ ID NO: 3504 - DNA, 540 bp, Homo sapiens
  misc_feature: GYAE6OF01BIOIK.39.31.C09.1.454.CMB.1.raw
  modified_base (531)..(531): a, c, t, g, unknown or other
  misc_feature (531)..(531): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatccgtacccggggagtcccggggtccctggaccgattcgagcggcaggcgggtctgagacagatttcactctcaccatcagcacgcctgcaggctgaagatgtggtctagtttattactgtcagcagtattagtagtacgtcctacgtagtacgttttacgggcccggggtaaccgaggtcgtaggacgtagtacgaaacgacgtagtcggcgtcgcgacctactctgttccttntcgtacccg

SEQ ID NO: 3505 - DNA, 644 bp, Homo sapiens
  misc_feature: GYAE6OF01DA6W8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagaattacttcgcttagggtaaccagacaagaaaaccaggacagccttcctaagttcgctcatttacgtgggactacgtccgtacccggggacggttcccggggtccctcggaacccgtattacgacggcgggcaggtccggggtctggagacagtatttcactctacacctatcagcagcctgcaggtactagaagtagttgtaggtactaagttttattactcgttcagtacttaggtaatttaacgttaggttaacgttccttacgtacggtttacgttttcggggacccgggggtaactaacggtcggttaaggaacgtaacgttaccgaaaacggtaccgtgggtaacggtctaccgggacctacccgttaagttccgttagttcccttaccgtcgtttaccccg

SEQ ID NO: 3506 - DNA, 612 bp, Homo sapiens
  misc_feature: GYAE6OF01DCEYY.39.31.C09.1.454.CMB.1.raw
  modified_base (302)..(302): a, c, t, g, unknown or other
  misc_feature (302)..(302): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctcgtgggcgagagggccacatcaactgcaagtccagccagagttgttttacacaggtaccaacaaataagaattacttcgcttggtaccagacaagaaaccaggacagcctacctaagttgctactatttacgnggcatccggtacccgggtacggtcccgggtccctggaccgtattccgagcggacaggccggtctaggacgacagtacttttcgactcctacaccatcgagcacgcctacgacgaggctaggaagtagttggtacggtcttaaggtttacttaacgtgtacgagtacgttaagttattagttaggttaccgtcctacgtaacggtttacggtttacggggacccgggtaacgtagtacgtaggacgaacgtaacgaacgtacgtggtacggcgtacgaccgacctacttctacttcgtctacgttcccccg

SEQ ID NO: 3507 - DNA, 712 bp, Homo sapiens
  misc_feature: GYAE6OF01B3ONN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccgatcaactgacaagtccagccagagttgtttacacgacggtccaaacaataagtaacttacttcgacttggtaccagaccaagaaacccaggacacggtcctaccgttaagtgacctactattttacgtgggactaacgttccgtaacccggggtacggttcccggggtaccctggaccgtattccgacggcggcacggtcggggtactggaacgactagtacttttacgaccttctaccgacctatcgacgtccacgtcccgtacgaccggtacggacgttaggaacgtagttacggttaggtaccgttaacggtttttacgttacgttcggtaccgtagtaccgtaagtttaacttacgttacgtacgttaccttacgtacggttaccggttttcggggacccgggtaacacggttacgtagggtaacgtaccgtaaccgaaaccggttacgttaggttcggtaccgtcggtaccctaaccgtacgttaccgtttacgttacccttaccgttcgttacccccg

SEQ ID NO: 3508 - DNA, 595 bp, Homo sapiens
  misc_feature: GYAE6OF01CL22I.39.31.C09.1.454.CMB.1.raw
  modified_base (296)..(296): a, c, t, g, unknown or other
  misc_feature (296)..(296): n is a, c, g, or t
  modified_base (395)..(395): a, c, t, g, unknown or other
  misc_feature (395)..(395): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaaacaataagaattacttcgcttaggtaccagcaagaaaccaggacagcctctaagttgctctatttacnggcatccgacccgggagtcccggggtccctgaccgattcagcggcaggcgggtctgagacagtatttcactctcacatcagcacgctgcagctagaagntgtggactagtttatacgtgtacagtactagttattaataggttacgttacctacgtaacggttacgttttaggggaccggggtaacctaggtccgttaagggtaacgtaacgttaaccgaaaacggttacgttggtacggaccgttacgacccctaaccgtacgttaccgttacgtttaccttctaaccgtttcccccg

SEQ ID NO: 3509 - DNA, 533 bp, Homo sapiens
  misc_feature: GYAE6OF01D41VM.39.31.C09.1.454.CMB.1.raw
  modified_base (362)..(362): a, c, t, g, unknown or other
  misc_feature (362)..(362): n is a, c, g, or t
  modified_base (509)..(509): a, c, t, g, unknown or other
  misc_feature (509)..(509): n is a, c, g, or t
  modified_base (522)..(522): a, c, t, g, unknown or other
  misc_feature (522)..(522): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctctaagtgctcatttactggcatccgtacccgggagtcccggggtccctgaccgattcagcggcagcggtctgagacagtatttcactcncaccatcagcagcctgacaggctagaagtagtgtggacttagtttatacgtgtcagatagtattatagtagtcctatagtacgtttcgggaccgggtacacggtcgtaggagtacgtacgaaacgtacgtggtgcgtacgcaacctntactagttccttntaccttccccg

SEQ ID NO: 3510 - DNA, 757 bp, Homo sapiens
  misc_feature: GYAE6OF01DEBIO.39.31.C09.1.454.CMB.1.raw
  modified_base (511)..(511): a, c, t, g, unknown or other
  misc_feature (511)..(511): n is a, c, g, or t
  modified_base (713)..(713): a, c, t, g, unknown or other
  misc_feature (713)..(713): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtcgccgtacggggactagtcgtgatcgacccgagtcctccagacctcccgtggctgtcgtctcgtgggcgagacggcccacatacaactgacaacgtccacgaccaaggtacgtttacgtttaaccacgtacggtaacccaaaataaataacgtaactttaccgttcgtcgtttacggaaccagacaaacgaaaccgaggacacgtcctacgttaagtcgccttataacgttttcggaggactacgttaccccggtacccgggtaccggttcccgggtacccacggtaaccgtaccgttacggacggaccggtacggtcggggtaccggtaccgtaggaacgtaactacggtttactttacccaccgttacctaccctaacctacaccggaacncccgtaacgtcccgtacggaaccggtaggtaccggtaagtaaacgttaggttcggttaaggtacctttaagtttaccgttagtaacgtcgtaagtacgtttaagtttaattaaccggttacggttactacccgttaaagggttcggtttaaccggtccgggaacggtaacctaggtcggaagtacgtactaacgaacgtcgngtaccggtcacgtccactacgttctacttctacgtccttacccg

SEQ ID NO: 3511 - DNA, 657 bp, Homo sapiens
  misc_feature: GYAE6OF01EYX4P.39.31.C09.1.454.CMB.1.raw
  modified_base (118)..(118): a, c, t, g, unknown or other
  misc_feature (118)..(118): n is a, c, g, or t
  modified_base (300)..(300): a, c, t, g, unknown or other
  misc_feature (300)..(300): n is a, c, g, or t
tcagtcgcactagtcacgaccggtgctcgatttagacgtctcatcaaggaaggaaggggcagcaagatggtgttgcagacccaggtcttcatttctctgttgctctggatctctggtncctacgggacatcgtgatgacccagtctccagacctccctggctgtgtctctgggcgagagggccaccatcaaactgacaagtccagccagagttgtttacacgacggtccaaacaataaagaattacttcgcttggtacagcaagaaaccaggacagcctacctaagtgctctatttacgngggcagtccgtacccgggtacgtcccgggtccctacgacctattcgagccggtacgacgcggtctaggagacgagtatttaccgactccacctaccgattcgagcacgcccttagcacggctagaagagtggtgtattaagtttattacgtggtcaggtactaagttactttagtaagttccgttaacctacgttaacgggttacctttcgggggacccggggtaacgaacggttcggtaacgggtagtaaaccgttaaaccgtaaaccggtaaaccgttcggtaacgggttccttaaccggcgtaaaccccgtgttaccttaccggttacccttttacgcccgttttaacccccgg

SEQ ID NO: 3512 - DNA, 527 bp, Homo sapiens
  misc_feature: GYAE6OF01DO5QB.39.31.C09.1.454.CMB.1.raw
  modified_base (291)..(291): a, c, t, g, unknown or other
  misc_feature (291)..(291): n is a, c, g, or t
  modified_base (519)..(519): a, c, t, g, unknown or other
  misc_feature (519)..(519): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctctaagttgctcatttacgnggcatcgtacccgggagtcccgggtcctgaccgattcagcgcagcggtctgagacagtactttcactctacaccatcagcacgcctgcagctagaagatgtgtactagtttatacgtgtacagtctagtattagtagtacgtcctacgtagtacgtttcgggaccgggtacagtcgtagacgtacgtacaaacgtacgtggtcggctacgaccacgtatctgtcttcncgttcccg

SEQ ID NO: 3513 - DNA, 538 bp, Homo sapiens
  misc_feature: GYAE6OF01BJ9JR.39.31.C09.1.454.CMB.1.raw
  modified_base (375)..(375): a, c, t, g, unknown or other
  misc_feature (375)..(375): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagattactcgcttggaccagcagaaaccaggacagcctcctaagttgctctatttacgtgggacctatccgtacccggggagtcccggggtccctggaccgattccgaggccggcaggcgggtctggagacagatttccactcncaccatcagcgacgtcctgcacggctagaagtatggtggactagtttactacgtgtcagctagttatagtagtgtcctctagtcgtttacgggccgggtacgacgtcgtaggagtacgactaaacggacgtgtggctcgacactctctgtccttgtcttcccg

SEQ ID NO: 3514 - DNA, 571 bp, Homo sapiens
  misc_feature: GYAE6OF01A25X3.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctcggaagatggtggctagtttattactgtcagcagtattatagttagtcctcgagtacgttttcgggaccggggtaccaaggtccgtagggtagtaaccgtaccgtaaaaccggtaacgttggttacgggccttacggaccgtaaccccgtaacgttccttacggtcctttccgtacgtttacccccg

SEQ ID NO: 3515 - DNA, 674 bp, Homo sapiens
  misc_feature: GYAE6OF01D4MWV.39.31.C09.1.454.CMB.1.raw
  modified_base (369)..(369): a, c, t, g, unknown or other
  misc_feature (369)..(369): n is a, c, g, or t
  modified_base (393)..(393): a, c, t, g, unknown or other
  misc_feature (393)..(393): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagccagccagagtgtttacacaggtccaaacaataagaattacttcgcttaggtaccagaccaagaaaccaggacagcctacctaaagttcgctcagtttactgggctaagtccgtacccggggagttcccggggtccctggacccgtagttacgacggcggcaggtccgggtntaggagaacagattttcaacttcncaccatcaagcgaagccctggacacggacgttaggaaagaagtggtacgtacgtaacgttttaatttaacgttcggttcaacgtctaaaggttaatttaagttaaggttaacgttacccgttacgtaaggtaccgttttttacggggacccggggggtaaccgtaaacggtccgttagggaaaacggtacgtaaacctaaaacgggtaaaaccgttggtacgggtcgttacgaccgtaaaccgttactcgttacgtttctttaccctaacgtttacccccg

SEQ ID NO: 3516 - DNA, 568 bp, Homo sapiens
  misc_feature: GYAE6OF01A25HP.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctcatttactgggcatccgtacccgggagtcccggggtcctgaccgattcgagcggcaggcggtctgacgacagtatttcactctcaccatcagcagcctgcgacggctagaagagtgtcggactagtttatacgtgtacagactagttattattagtacttcctactaaggtacgttttacggggaccggggtaacctaaggcgtagggaagacgtaacgaaacggtacgtaggtacggcgtacgtaccacctacttacttacgttaccttccgtacttccccg

SEQ ID NO: 3517 - DNA, 762 bp, Homo sapiens
  misc_feature: GYAE6OF01BV8L7.39.31.C09.1.454.CMB.1.raw
  modified_base (319)..(319): a, c, t, g, unknown or other
  misc_feature (319)..(319): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggacgggccaccatcaactgacaacgtccagccagtagttgtttacacgtaggtaccaacaataagtaacttacttcgcttaggtaccagacaacgaaaccaggacacgtcctacgtaagttcgcttactaattttacgngggactacgtaccgtacccggggtacggttcccggggtaccctacggaccgtacgttcgaacggccggacgtacgggtccgggttacgaggaacgtaccgtaaggttacttttacccgaaccttcctacctaaccctataccgaacgtccgaacgtcccgtacgaccggacggtacgttaggaaagtagtgggtacggtacgtttaagttttaacgttacgttacgtaccgtaggtacgttaagtttaagtttaacgttaacggttaccgttaccgttaaccggttaacgggtttaccgggttttaccggggacccgggggtaactaacggtacggtacgggtaacgtaaccggttaaaccgaaaacggttacgttacggtacgggtacgaccggtacctaaccgtacgttccgttagttaccttacgtaccgtttacccccg

SEQ ID NO: 3518 - DNA, 704 bp, Homo sapiens
  misc_feature: GYAE6OF01B9QTQ.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagtgctcatttacgngggcatcctacccggggagtccggggtccctggacccgtattccaggccggcgacggccgggtactggaacgactaggtacttttccacttctacaccgtatcagtcacgcccgtgaccgaggtcctaggaacgtagtcggttaggtacttaaggttttaattaccgttggtaccgtaaggtaccttaaggtttaatttaacgttacggttaacgtttacccgtacgtaacggttaccggtttttaccggggaaccccggggttaacccgtaaggtcccggttacgggtaaacggtaaccgttaaacccggtaaaacgggttaaccgttgggttaacgggtacccttacggtaaccctacccggttaacgtttcccgttacggtttcccttaccgtaccgttttaccccccgg

SEQ ID NO: 3519 - DNA, 731 bp, Homo sapiens
  misc_feature: GYAE6OF01EY1LL.39.31.C09.1.454.CMB.1.raw
  modified_base (305)..(305): a, c, t, g, unknown or other
  misc_feature (305)..(305): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccacatcaactgacaagtccagccagtagttgtttacacaggtaccaaacaataagaattacttcgacttggtaccagacagaaaccaggacacgtcctacctaagttcgctctatttacgnggctagtccgtacccgggtacgtcccgggtccctggaccgtattcacggcgacacgtcgttctagagactagtactttacaccttctaccaccgtatccgacgaccgacgtcccgtcgaccgtacggcgtaaggaaacggtagttagggtacggttaccgtttaaggttttaaccgttaaccggtttacgtaccgtaagtaccgtttaagtttaacgttttaagttaacggtttaccgttacccgttacggttaacgggtttaccgggtttttaccgggggaacccgggttaaccgtaagggttaccgtagggtaacgtaaaccgttaaccggtaaaaccggtaacggttagggtaccgggtaccttaccgggaccgttaacccgtacgtttacgttacgtttacccttcgtacccgtttaccccg

SEQ ID NO: 3520 - DNA, 767 bp, Homo sapiens
  misc_feature: GYAE6OF01A53C9.39.31.C09.1.454.CMB.1.raw
  modified_base (326)..(326): a, c, t, g, unknown or other
  misc_feature (326)..(326): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgaggacgggcccaccatcaactgacaacgtccagccagtagttgtttacacgacggtaccaaacaataagtaactttacgttcgtcgttacggtaccagacaacgaaaccgaggacacgacctaccgtaagttcgctactatttacgngggacctacgtacccggtacccgggtaccggttcccggggtccctacggaccgtacttccggacggccggcgacggtccggggttacgtaggaacgacgtacgttactttacctaccgttacctaccctaaccctagtaccgacgtaccgacgtcccgtggacgaacggtcgtaaggaacggttagtacgggtacggtacgttaacgttttacgttacgtacgtacgtacgtattaagtttaattaagttaacgttaccgttaccgttaacgtacgggtttaccgggttttcggggaacccggggtaactacgggtaccggtaggtaaacgtaccgtaaaccggtaaacggtccggttaggtaccgggttaccgtaccgtacccgtaaaccgttacgtttacccgttaccgtttaccctttaccgtcccgttaacccccgg

SEQ ID NO: 3521 - DNA, 731 bp, Homo sapiens
  misc_feature: GYAE6OF01E4FME.39.31.C09.1.454.CMB.1.raw
tcagtcgcactagtcacgaccggtgctcgatttagacgtctcatcaaggaaggaaggggcagcaagatggtgttcgcagacccaggtcgttcatttcgtcctgttcgctctggactctctggtgcctacggggacatcgtgagtgacccagtctccagactccctggctgtgtctctgggcgagagggccaccatcaatgcaagtccagccagagtacgtttacacacggtaccaacaataacgaattacttacgtcttggtaccaggacaacggaaaaccacggaccacgccgtacctaaacggttcgaccctaattttaccgtggggtaccactaccgtaacccgggacggttcccgggggtaccctacggacccgtacttccgaacggccggacgagggtccgggttcgtaggacgaacgtaaggtaacgtttaccgtaaccgttccctacctaaccctaacgtaccgtaacggccgtaacggacccgttacggaccgaacgggtacgtacggaaaggtacgttgggtcggtacgttaagttttacgttacgtggtacgacgtacgtaagttacttaacgttagtacgttccgtacgacggttcggtttaccggggaccgggtaccgaaggtcggtacggacgtacgtaaccgaaaccgtacgtacggtacggcgtcgacccgtacgtacgttccgttacggttaccttacctcgttcccgtaccccg

SEQ ID NO: 3522 - DNA, 782 bp, Homo sapiens
  misc_feature: GYAE6OF01CZONN.39.31.C09.1.454.CMB.1.raw
  modified_base (325)..(325): a, c, t, g, unknown or other
  misc_feature (325)..(325): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggacgggccacccatcaactcgcaacgtccagccagtagttgttttaacacaggtaccaaacaataagaattacgttcgcttggtaaccagacaacgaaaccaggacacgcccttacctaaggttcgaccttacgtattttaccgngggtacactaccggtaccccgggacggttccccgggggtcccttacggaacccgttagttaccgacggtccgggcgtacgggaccggggttctaggaactaacgtaagtacttttacccacgtcccttacccacctaatccgaacgaccgtacgaccctggaccgaggacgttaaggaaacgtagttgggtacggtactttaacggttttacttaccgttacgtacgtagtacgtttaagtttaagtttaacgttacgtttaaccgttacccgttacggttaacggtttcccggggttttaaccgggggaccccggggtaaaccgtaacggtccggttaagggtaaacgtaaaccgtaaccggtaaaaccgtacggtttacggtacggtacccgttacggtaaccccacgtttaaccttccgttacgtttcccttaacccgtccgttttaacccccg

SEQ ID NO: 3523 - DNA, 623 bp, Homo sapiens
  misc_feature: GYAE6OF01EJJOQ.39.31.C09.1.454.CMB.1.raw
  modified_base (304)..(304): a, c, t, g, unknown or other
  misc_feature (304)..(304): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctggctgtgtctcgtgggcgagagggccaccatcaactgcaagtccagccagagttgttttacacgacgtaccaaacaataagtaattacttcgcttggaccagacaagaaaccaggacacgcctacctaagttgctctatttacngggactagtccgtaccgggtacggtcccggggtcctacgaccgtacttcaggtcggcacggcgggtctgacgacagtatttcactctcaccatcagcacgctgcaggctagaagtagtaggtacggtacgtagttttaacttactagtctagtactagttattacgtagttacgtcctacgtaacggttccgtttacggggaccggggaaccgacggtacggtagggtaacggtacgtaaaccgtaaaccggtaacgttagggtacggtcgtacgaccaaccgtacttaccgttacgttccttaccgtccgttaccccg

SEQ ID NO: 3524 - DNA, 538 bp, Homo sapiens
  misc_feature: GYAE6OF01AZOLB.39.31.C09.1.454.CMB.1.raw
  modified_base (292)..(292): a, c, t, g, unknown or other
  misc_feature (292)..(292): n is a, c, g, or t
  modified_base (397)..(397): a, c, t, g, unknown or other
  misc_feature (397)..(397): n is a, c, g, or t
  modified_base (503)..(503): a, c, t, g, unknown or other
  misc_feature (503)..(503): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacagcctctaagttgctcatttacgngggcatcgtacccgggagtcccgggtcctgaccgattcgagcggcacggcgggtctgacgacagtactttcactctacaccatcagcagcctgcagtctagaagntgtgactagtttactctgcagcgtagtattatagtacgtcctagtaggttcgtttcgggaccgggaactaggcgtagacgtagtaccgaaacgtacgttgcggtcncggacacctgttacttcgtcttcgtcgttaccccg

SEQ ID NO: 3525 - DNA, 658 bp, Homo sapiens
  misc_feature: GYAE6OF01E1N7Z.39.31.C09.1.454.CMB.1.raw
  modified_base (300)..(300): a, c, t, g, unknown or other
  misc_feature (300)..(300): n is a, c, g, or t
  modified_base (621)..(621): a, c, t, g, unknown or other
  misc_feature (621)..(621): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagaggccaccatcaactgcaagtccagccagagttgtttacacaggtaccaaacaataagaattactcgcttggtaccagcaagaaaccgaggacagcctacctaagttcgctctatttacgngggcatccgtacccgggagtcccggggtccctcggaccgtacttcgagcggcaggcgggtctgagactagtatttccactctaccaccgtatcgagcacgcctgacgaggtcagtaacgagttggtacggtacgttaagttttaacttacgtcggtacgacgtacgttaagtttaattagttaacgtaccgttacccgtaacgttacgggtttaaccggttttccgggggaacccgggggtaacctaacgggtccggtagggtaagtaacggtaaaccgtaaaaccggtacgttaggtacggtctacgtaccgtaaccgtnttacccgttacgttaccttaccgtccgtttacccccg

SEQ ID NO: 3526 - DNA, 645 bp, Homo sapiens
  misc_feature: GYAE6OF01CI2XZ.39.31.C09.1.454.CMB.1.raw
  modified_base (573)..(573): a, c, t, g, unknown or other
  misc_feature (573)..(573): n is a, c, g, or t
  modified_base (611)..(611): a, c, t, g, unknown or other
  misc_feature (611)..(611): n is a, c, g, or t
  modified_base (637)..(637): a, c, t, g, unknown or other
  misc_feature (637)..(637): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgagagggccacatcaactgacaagtccagccagagttagttttacacgacggtaccaaacaaataagtaattacgtcgtcttacggtaccagacaaagaaaccaggaaccacgccttaccgtaagttcgcctactatttaacgcgggactacgtccggtaacccgggtacggtcccggggtaccctacggaaccgtacgttcgacggaccggcgacggtccgggtactaggaacgacgtacgtactttccaaccgtcctaccgaacctagtaccgaacgctacgcccgtaggaccggaggtactaggaaagtcgtaggtacgtacttagtttactacgtgtaccagtactattattagtactcgtacctagacgttcggttacgggacccggtaanagtcgaggacgtactaaccgaaacgtcgtaggcgtacncgaccctaagtcttcttgtaccttcncgttcccg

SEQ ID NO: 3527 - DNA, 639 bp, Homo sapiens
  misc_feature: GYAE6OF01A6GLB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggagggccaccatcaactgcaacgtccagccagagttcgttttaacactacggtaccaaacaataagaattactcgcttaggtaccagacaagaaaccaggacacgtcctactaagttcgctactacgtttacgtgggcacgttccggtacccggggtacggtcccggggtccctacggacccgtattcgacggccggacgacggccggggtctaggacgacgagttactttaccgaccttcctaccaacctactacgacgcacgtcctagcgaggtctaggaagtagtggtaggtacttaagtttacgttacgtgtacagtactaagttattattacggtactctacgtacgtacggtttacggggaccgggtaacacggtcgtaggacgtactaacgtaaacggtcgttggtacggtctacggacctacgtacttcttaccgttcttcgtaccgttccccg

SEQ ID NO: 3528 - DNA, 816 bp, Homo sapiens
  misc_feature: GYAE6OF01DXUFM.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagacctccctggctgtgtctcgtgggcgagacgggccaccatcaactgacaagtccagccagtagttcgttttacacgacggtaccaaacaaacgtaaagtaactttaaccttcgtacgtttacggtaaccagaccgaaacggaaaaccaggaaccacgtcccttacgtaagttgacctacttaactttacgtcgggcctacgttacccggtaacccgggggtacggttcccgggggtaccctcggaacccgtacgttccgacgggtaccgggcgtacgggtccggggtactaggaacgtaactacggttaacttttcccaacttccctaacgaaccctacgtacgtaaacggtccaaccggtccgtacggaccgtaacgggtaccgtaggtaaacggtaggttagggttacggtacgtttaaggtttttaacgttaacgttcggtaacgtaacggtaacgtttaaagtttaactttaacggtttaacgttaacgtttacccgttaacggttaacgggtttaccggttttaccgggggaacccgggggttaaccgtacgggtaccggtacgggtaacgtaaccgttaaaccgaaacggtacggttaggttacggtcgttaccgtaccaaccgtcgttacgttcgtttaccttcgttccttacccccgg

SEQ ID NO: 3529 - DNA, 537 bp, Homo sapiens
  misc_feature: GYAE6OF01EK33L.39.31.C09.1.454.CMB.1.raw
  modified_base (528)..(528): a, c, t, g, unknown or other
  misc_feature (528)..(528): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctctatttactgggcatccgtacccgggagtcccggggtccctgaccgattcagcggcaggcgggtctgagacagatttcactctcaccatcagcagcctgcaggctgaagatggtggtctagtttacttactgtcagctagttattatagtacgtcctcgtacgtacgttttcgggacccggggtaaccaggcgtgggaagacgtaacgaaacgtacgtggtggctcgcactactcgtctcttcncgttccccg

SEQ ID NO: 3530 - DNA, 625 bp, Homo sapiens
  misc_feature: GYAE6OF01CGCV3.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctctgggcgagaggccacatcaactgcaagtccagccagagttgtttacacaggtaccaaacaataagaattacttcgcttaggtaccagcaagaaaccaggacagccctactaagttgctctatttacgngggcatccgtacccgggagttcccggggtcctgaccgtattccaggcggtacaggccgggtctgaagtacagtactttcactctacacctatcaagcacgcctgacgagcgtagaagtagtcgtggtactagttttatacgtcgtacagtctaagtaattataagtacgttacctacgtacgttaccggtttacgggacccggggtaactaacggtcgtaacgggtagtaacgtaaccgaaaaaccggtacgttacggtacggtacccgtacggacccgtaaccgtacgttaccgttacggttacctttccgtacctttacccccgg

SEQ ID NO: 3531 - DNA, 636 bp, Homo sapiens
  misc_feature: GYAE6OF01B15UL.39.31.C09.1.454.CMB.1.raw
  modified_base (423)..(423): a, c, t, g, unknown or other
  misc_feature (423)..(423): n is a, c, g, or t
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaataagaattactcgcttggtaccagcaagaaaccaggacacgcctacgtaagttgctcatttactgggcatccgtacccggggacggtcccggggtccctcggaccgtacttacgaggcggacgacggtcggggtctaggagacagtatttcactctcactatcagcacgtcctagcgaggctaggaagtntggtaggtactagttttacttacgtgtacagactaaggttattaagtaggttacgtaccttcgtaacggttacggttttaccggggacccggggtaaccaggtaccggtagggtaacgtacgtaaaccggtaaaaccggtaacgttgggtacggtacctacggtaccgtaaccctacgttcccgttagttccctttaccgtcgtttacccccg

SEQ ID NO: 3532 - DNA, 604 bp, Homo sapiens
  misc_feature: GYAE6OF01DKFN6.39.31.C09.1.454.CMB.1.raw
  modified_base (312)..(312): a, c, t, g, unknown or other
  misc_feature (312)..(312): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccagagttgttttaaccacgaggtaccaaacaataaagaattacttacgtcttaggtaaccagacaagaaaccaggaccacgcctactaagttgctctatttacgnggcatccgtacccgggagtcccggggtcctcgaccgtattcgacgcggcgagcggtcngagacagtcttcactcacaccntacagcaggcctgacgaggctagaaagtgtggcggtacttaagttttactactgtacgagtacgtaagttaagttacttaggttaacctcgttaccgtaaggtttaccggtttacggggcccggggtaactacggtgtacgaagttaccaacgaaaccgtacgtaggtcggtcgtacgcctactacgttcttccgttacttctagttccccg

SEQ ID NO: 3533 - DNA, 789 bp, Homo sapiens
  misc_feature: GYAE6OF01DYIKD.39.31.C09.1.454.CMB.1.raw
  modified_base (129)..(129): a, c, t, g, unknown or other
  misc_feature (129)..(129): n is a, c, g, or t
  modified_base (348)..(348): a, c, t, g, unknown or other
  misc_feature (348)..(348): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggganatcgtgatcgacccagtctccagtactcccgtggctgtgtctcgtgggcgagacggaccacgataccaacgtgacaacgtccagccaagtagttacgtttacacgtacggtaccaaataataacgtattaccgttcgacgttacggtaccagtaccgaaacgtaaaccgaggtacctacggtcccttacgtaagttcgaccttacgtacgttttaccgngggtacctacgtccggtaccggggtacggttccccggggtacctaggtacccgtagttaccggacggtcggtaccgtaacggggtccgggttacgtacggaaccgtaacgttaaggttaccttttacccgacgttaccggttaaccaacccgtacgttaccgaacgtaccggtacgttacccgtacgggtacccgtaacgggtaccgttaaggtaaacccgttaggtaccgggttaacggtaccgttttaacggttttaaccgtaacgttacggtaaccgtacggttaacgtaacgtttacgttaacgtacgttacgtacccttaggtaccgttacggtttacgggaccggtaagtacgtcggtaaggtaacgtaaacgtaagtcggtcgtacgtctacggtacctacccgtattcgtcgtacttctacgttccgtaccgg

SEQ ID NO: 3534 - DNA, 637 bp, Homo sapiens
  misc_feature: GYAE6OF01BVSKO.39.31.C09.1.454.CMB.1.raw
  modified_base (313)..(313): a, c, t, g, unknown or other
  misc_feature (313)..(313): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggacgggcccaccatcaactgacaagtccagccagagttgtttacacgagtaccaaactaaataagtaattaccttcgcttacggtaccagacaacgaaaccaggacacgcctacgtaagtcgctctatttacgnggcatccgaccggaggtcccgggtccagaccgattcgacggcggcgaggcgggtctaggaagacgtaagtactttcactctacacatcagccagcctgcgaggtctaggaagtagtggtcggacgttaagtttacttacgtcgtaccgagtactaagtttaagttaagttaggttaccgtaccgttacgtaacggtttaccggtttaccggggacccggggttaacaagggtcgtacgggtaagtacgtaaaccggaaacgtaacggtggtacgtccgtacgacctaaccgtacttctacggtttacctcgttcccgtaccccg

SEQ ID NO: 3535 - DNA, 760 bp, Homo sapiens
  misc_feature: GYAE6OF01DUG0G.39.31.C09.1.454.CMB.1.raw
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagacctccctggctgtgtctcgtgggcgaggagggccaccatcaactgacaagtccagccagtagttgtttaacacgaggtaccaaacaataagtaattacttcgcttaggtaccagacaagaaaccgagacacgacctacctaagtcgctactatttacgcggactacgtccggtaacccggggtacggtcccggggttaccctacggtaacccgtagtttaccgacgggaccggccggtaacgggccgggttacctaggaacggtaaccaggttattttacccaccgttctaccaaacctactacgaacgacgtacgtccgtacggccgaacggtacgtaaggtaaacgtagttgggtacggtcgttaagttttacttaacgtgtaacgtagtaccgtaagtttaacgtgttaaacggttcgtaccgttaggtacggtttaccgggttttaccggggaaacccggggtaataacggttcgggtaagtaacccggtaaccgtaaaacggtaaaacccgggttaatacggggttaccggtaaccgttacggaaccccgtaacgtaccgttacttaccggggtttccctacgttcccgtttaaacccccgg

SEQ ID NO: 3536 - DNA, 514 bp, Homo sapiens
  misc_feature: GYAE6OF01AIFOY.39.31.C09.1.454.CMB.1.raw
  modified_base (508)..(508): a, c, t, g, unknown or other
  misc_feature (508)..(508): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgagatgtgctagtttattactgtcagctagtattatagtagtcctcgagtacgttttggccggggtaccagtcgtaggagatacgaaacgtacgtagtcggtctgcaccgtactctgtcttctnttcccg

SEQ ID NO: 3537 - DNA, 550 bp, Homo sapiens
  misc_feature: GYAE6OF01DRPWZ.39.31.C09.1.454.CMB.1.raw
  modified_base (383)..(383): a, c, t, g, unknown or other
  misc_feature (383)..(383): n is a, c, g, or t
  modified_base (398)..(398): a, c, t, g, unknown or other
  misc_feature (398)..(398): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggcatcgtgatgacccagtctccagactccctggctgtgtctctgggcgagagggccaccatcaactgcaagtccagccagagtgttttacacaggtccaacaataagaattactcgcttggtaccagcacgaaaccaggacagcctactaagttgctctatttactgggcatccgtacccgggagtcccggggtcctgaccgtattcagcgcagcgggtctgagacagtatttcactctcacatcagtcagcctgcnggctagaagatgtgntagtttatactgtacagactagttattaagtagtaacgttccctagtagttaccgttttcggggacccggggtactacggtcgtaggactacgtacgaaacgtacgtgtacggtctcggaccaccgtacttctagttcctcgtcttaccccg

SEQ ID NO: 3538 - DNA, 626 bp, Homo sapiens
  misc_feature: GYAE6OF01AO6H7.39.31.C09.1.454.CMB.1.raw
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (601)..(601): a, c, t, g, unknown or other
  misc_feature (601)..(601): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgtttacacaggtccaaacaataagaattacttcgcttggtaccagcaagaaaccaggacacgcctctaagtgctcatttactgggacagtccgtaacccggggtgtacccggggtcctggaccgtattcgacgcggacaggccgggtctggacgacaggtactttcactctaccgacntacgancgacgcctgcaggcgtagaagacgttggtacggtactagtttactcgtacgtacgagtactaagttaacttagttaacgttacgttaccgtacgtaacggttaccggttttacggggaccggggttaaccaacggtcgtaggtaacgtacgtaaccgaaaacggtacgtgggtaccggtacgtcggtacctaacgtacttccgttnttaccgttaccgtacgttacccccg

SEQ ID NO: 3539 - DNA, 835 bp, Homo sapiens
  misc_feature: GYAE6OF01CXIA7.39.31.C09.1.454.CMB.1.raw
  modified_base (316)..(316): a, c, t, g, unknown or other
  misc_feature (316)..(316): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggaggccaccatcaactgcaagtccagccagagttgtttacacgaggtaccaacaataagtaacttacttcgtcgttacggtaaccagacaagaaacccgaggacacgtcctccgtaagttcgctctaagtttacgnggcactccggtacccgggacggtcccggggtcctcggaaccgtattcgaggccgggtcacgggtccggttcaggacgactaagttctttacacgtcctaccacagtacacgtacgacgtcctaggacctagggtacctaaggtaaggtacgtttcgggtaacggttaaccgttaagggttttttaaccttaccggtttaacggttacgtaacggtaccgtttaaaggtttaacttttaaacggtttaacggttaacccgttacccggttaaccggttaaaccgggttttacccggggttttacccggggggaaaccccggggggttaaaccgtaacgggtaccgggttaacgggaaaaccggttaaacccgtttaaacccgggtaaaaacccgggttaaaccgggtttccgggtaacgggttacccggtacccgttaaaccccggtaaacccgttaccgtttaaccccgttaccggtttttaccccgttaaccgtttaacccccgtttaaccccccggg

SEQ ID NO: 3540 - DNA, 555 bp, Homo sapiens
  misc_feature: GYAE6OF01CPYBO.39.31.C09.1.454.CMB.1.raw
  modified_base (538)..(538): a, c, t, g, unknown or other
  misc_feature (538)..(538): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagacaagaaaccaggacagcctcctaagttgctcatttactggcatcgtacccgggagtcccggggtcctgaccgattcagcggcagcgggtctgagacagtatttcactctacaccatcgagcagcctgacacggtctagaagtagtggtcggtactagttttatacgtcgttacagtctaagttattatagttaacgtcctacgtagttaccggtttcgggacccggggtacaggtcgtaggacgtaagtacgaaacgtacgttgtacggctcgacaccgtntctagtctctcgttccc

SEQ ID NO: 3541 - DNA, 593 bp, Homo sapiens
  misc_feature: GYAE6OF01B6GPJ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacagcctacctaagttgctcatttactgggcatccgtacccgggagtcccggggtccctgaccgtattcagcggcaggcgggtctgagacagtatttcactctcaccatcagcagcctgcaggctagaagtagtggtggactaagtttacttacgtgtacagctaagttaattagtagtacgttcctagtacgttacggtttcggggaccgggggtaaccaaggtcgtagggaacgtacgtaaccgtaaaacggtaaccgttggtacgggtacctcggaccctaacccgtacttcttacgtttccctttaccgtacctttacccccg

SEQ ID NO: 3542 - DNA, 635 bp, Homo sapiens
  misc_feature: GYAE6OF01E06LK.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaaacaaataagaattacttcgcttggtaccagcaagaaaccaggacagcctacctaagttgctcatttacgnggccagtccgtacccggggaggtcccggggtccctggaccgagtttccgacggtccggacgacggtcggtacgtagacgtacgtagtaatttccaccgttcctaccaacccataccgagccgtacgcctacggcgtacggcgtaggaagtagtcggtgtactaagtttattacgtgtacacgtactaagttaattagtagtacgttacctacgtacggttacggtttaccgggaccggggtaactacggtcggtaggaagtaacgtaacgtaaacgtacggtacggtacggtcgtacgccgtaacctcgttactgttccgtttctaccgttaccccg

SEQ ID NO: 3543 - DNA, 773 bp, Homo sapiens
  misc_feature: GYAE6OF01AISWV.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtcgccgtacgggacatcgtgatcgacccagtcctccagacctccctggctgtgtctcgtggcgagacggccaccatacaactgacaacgtccagccagtagttgtttaacacgtacggtaccaaactaagtaagtaactttaccgttcgtcttacggtaaccacgacgaacgaaaccgagacacgaccttacgtaagttgacctcgtaactttacgtcgggtacacgttaccggtacccgggtacggttcccggggtccctacggaaccgtacttcgacggccggacgtacggccggtactaggacgtacgtagttacgtttaccaccttccgtaccaccctacgttaccgacggtaccgacgtcccgtacgaccgaacgggtacgtaaggtaaagtggttacggtacgggtaaccttttaagttttaactttaccggtgtaacccgtagtaacgttagtttaacgtttaagttacggtttaccgtacccgttaacggtaaccgggtttacgtttaccggggggtaaccccgggaacgttaacgggccgttaaggggtaactaaccgttaaaccgaaaccggtttacggttacgcggttacctaccggtacccaaccgttacgttcccgttagttccctttacgcccgtttccccgg

SEQ ID NO: 3544 - DNA, 548 bp, Homo sapiens
  misc_feature: GYAE6OF01ELZ5K.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttcgctctatttactgggcatcctacccgggagtccgggtccctgaccgattcagcgcagcggtctgacgacagatttcactctcacatcagcagcctgcaggctagaagtatgtggctagtttatcgtgtcagctagttattatagtcgtcctcagttacgtttcgggacccgggtacaaggcgtaggacgtataaccgaaacgtacgtggtacggtcctacggaccctaaccgtacttaccgttagttcctttctacgtttaccccg

SEQ ID NO: 3545 - DNA, 749 bp, Homo sapiens
  misc_feature: GYAE6OF01BH3E9.39.31.C09.1.454.CMB.1.raw
  modified_base (339)..(339): a, c, t, g, unknown or other
  misc_feature (339)..(339): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgaggacgggccaccatcaactgacaagtccagccagtagttgtttaacacacggtaccaaactaataaagtaactttacgttcgtacttacggtaccagaccaacggaaaaccgaggaactacggaccttaccgtaaagttcgacctactaagttttacgnggacctacgtccgtaacccggggacgtcccgggggtaccctcggaccgtacgttcgaacggcgggtacacgggtcgggtctaggacgaacgtagtactttcactcctacaccacgtcaagctaacgcctcggacgagggtaccgttaaggaaacgtcggtacggtcgggtaacttaacggtttttaacgtaccgttagtacgtacgggttaccttaaaggtttaagttaacgtaaggtttaacccgttcccgttaaggtaccgggtttaacggttttccgggggaacccggggtaacctaaggttccggtaaggtacgtaaacgtaaccgtaaaacggtaccgttggacggtccgttacgaccgtaccgttacgtaccgttcggttacccttcgtaaccgtttacccccg

SEQ ID NO: 3546 - DNA, 751 bp, Homo sapiens
  misc_feature: GYAE6OF01EBZ23.39.31.C09.1.454.CMB.1.raw
  modified_base (232)..(232): a, c, t, g, unknown or other
  misc_feature (232)..(232): n is a, c, g, or t
  modified_base (305)..(305): a, c, t, g, unknown or other
  misc_feature (305)..(305): n is a, c, g, or t
tcagtcgcactagtcacgaccggtgctcgatttagacgtctcatcaaggaaggaaggggcagcaagatggttttgcagacccaggtcttcatttctctgttgctctggatctctggtgcctacggggacatcgtgatgacccagtctccagactccctggctgtgtctcgtgggcgaggagggcccaccatcaactgcaagtccagccagagttgtttaccacaggtccaanaataagaacttacttcgtcttggtaccagcaacgaaaccaggacacgcctcctaagttcgctctactttacgngggccagtccggtacccggggtacggtccggggtccctgacccgtattcgacggtccggacgtacgggtccgggtcgtaggaacgactacggtactttccgaacttcccgtaccacccgtaatccgaacggccaacgtcccgtcgaccgaggtaccgtaggaaggtacgtggtacggtacttaaggtttttaacttacgttgtactacggtacgttaagtttaacgtttagtacgtttacggtacccttacgtacggtttaccgggttttaccgggggaacccggggttaaccgaaccgggttacgtaacggggtaactaacggttaaaaccggtaaaccggtaaccgtttacgggtccgggtaccgttacggacccgtaaacccgttacgttttacccgttaccggtttcctttaaccgtcccgtttcccccgtttaacccccgg

SEQ ID NO: 3547 - DNA, 685 bp, Homo sapiens
  misc_feature: GYAE6OF01ENSPB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagacgggccaccatacgaactcgacaagtccagccagtagttgttttacactacggtaccaaacaaataagaacttaacttccgacgttaggaccagacaagaaaccgaggacacgtacctaccgtaagttgccttactactttacgtgggactacgtaccgtaccccggggtacggttaccccggggtccctacgtacccgtacttaccgacggtccggcgacggtcgggtaccgtaggaacgtactacgttacgtttaccacttcctaccgaccgtataccgagcctacgccgtagcagggcctaggaacgtagttacggtacggtacgttaagtttacttacgtacgtcgtacgtacgtaagtttactagttacgtacttcgtacgtacgttacggtttcgggacgggtaacgacggtacgtacggagtaacgtaaccgtaaacggtcgttagggtcgtcgtaccgtaccgtacctagttaccgttagttaccttctccgttacccg

SEQ ID NO: 3548 - DNA, 613 bp, Homo sapiens
  misc_feature: GYAE6OF01DZRJZ.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcagaaaccaggacagacctctaagttgctctatttacgngggcatccgtacccgggagtccggggtcctggaccgattcgacgcggcaggcggtctgagacagtatttcactctcacatcagcacgcctgacgaggctagaacgtagtgtggtactagttttactacgttgacgtagactagttaattataagtacgtcctacgaggtttacggtttacggggacccggggtaacctaaggccgtagggaacgtaaccgtaacgtaaaacggtaccggttaggtacggtaccgttcggaaccctaacccggttaaacgttccgtttaccgttacctttaccgtaccgtttaccccccg

SEQ ID NO: 3549 - DNA, 552 bp, Homo sapiens
  misc_feature: GYAE6OF01AVE8V.39.31.C09.1.454.CMB.1.raw
  modified_base (375)..(375): a, c, t, g, unknown or other
  misc_feature (375)..(375): n is a, c, g, or t
  modified_base (441)..(441): a, c, t, g, unknown or other
  misc_feature (441)..(441): n is a, c, g, or t
  modified_base (539)..(539): a, c, t, g, unknown or other
  misc_feature (539)..(539): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcagtctacccggggagtccggggtccctggaccgattcagcggcaggcgggtctgagacagatttcactctcaccatcancagcctgcaggctgaagactggtaggctagtttattactgtcagacagtattagtagttatcctanagtacgtttcgggccgggggtacaagccgtaggacgtataccgaaaacgtacgtaggttcggacttcggacctaaccgtaattcgttacgtttccttnaccgtttaccccg

SEQ ID NO: 3550 - DNA, 665 bp, Homo sapiens
  misc_feature: GYAE6OF01EAW01.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttacactaggtaccaacaataagaatttacttcgtcttggtaccagacaagaaaccaggacagcctacctaagttgctactatttacgtgggactagtccgtaacccggggacggtcccgggtccctgaccgtattcgacgtcggacacgcggtctagagacagtactttcactctacacctataccgagtaccacgccgtcgacgtaggcctagaaagtagttaggtacggtacttaagttttaacttacgttgtacgagtaccgtaagtttattaagtaagttaccgttaccttacgtacggttaccgttttacggggaacccggggtaacgaacggtcgtaagggtaacgtaacgtaaaccgtaaaccggtaacgttacgggtacggtccgacggtaccctaccgttaacgttccgtttacgttccctttaacgtccgtttacccccgg

SEQ ID NO: 3551 - DNA, 657 bp, Homo sapiens
  misc_feature: GYAE6OF01EQIYL.39.31.C09.1.454.CMB.1.raw
  modified_base (304)..(304): a, c, t, g, unknown or other
  misc_feature (304)..(304): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccgagacctccctggctgtgtctcgtgggcgagacgggccaccatcaactgcaagtccagcagagtgtttaacacagtaccaaacaataagaattacttcgcttaggtaccagacaagaaaccaggacacgcctacctaagttgctctaatttacgngggcacgtccgtacccggggtacggtcccggggtccctaggaacccgtattcgacggccggacgacggcgggtctaggaagacgtaagtagtttcaacttcctacaaccatcaagcacgccgtcgcgacggacgtaggaagtagtggtaggtacgttaagtttaattacgtgtacagtactaagttaattagtagtaacgttaccgttacgtaagttaccggttttacggggacccggggtaaccgaacggtaccgtagggaacgtaaacgtaaccgtaaaaccggtaacgttaggtacggtaccgtacgtacccgaaccctattaccgttagttcttactaccgttaccccg

SEQ ID NO: 3552 - DNA, 726 bp, Homo sapiens
  misc_feature: GYAE6OF01APUX1.39.31.C09.1.454.CMB.1.raw
  modified_base (519)..(519): a, c, t, g, unknown or other
  misc_feature (519)..(519): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagacctccctggctgtgtctcgtgggcgaggacggccaccactcactgacaacgtccagccagtagttcgtttacaccgtacgtaccaaactaaagtaagtaactttaccttccgtacgttacggtaaccacgacgaaacgaaaacccgaggacacgtaccctaccgttaaggtcgcttactaacgtttacgtcgggcctacttcccggtaacccgggtacggttcccgggtcccgtacgaccggtacttcggacgccggcgacggtcgggtacgtgaacgacgtaagtcttaccgactctcacctactcgagccgtacgacctcggacgtaggcgtaaggaacgtagtggtacgtacgtttaacgttttntaccgttcgtacgacggttactagtttaattagttaacttacggttcctttacgacggtttacccgggttacggggacccgggtaacgacgttacggtacggaacgtaaacgttaaccggaaaagttccgtacgggttaccggacgtcccgtaccaaccggtttcgtaccgtttaccgtttacccgtaccgttcccgttaccccccg

SEQ ID NO: 3553 - DNA, 674 bp, Homo sapiens
  misc_feature: GYAE6OF01AW4WZ.39.31.C09.1.454.CMB.1.raw
  modified_base (310)..(310): a, c, t, g, unknown or other
  misc_feature (310)..(310): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggaggccaccatcaactgcaagtccagccagagttgttttacacaggtaccaacaataagtaattacttcgcgttggtaccagcaacgaaaccaggacacgcctaccgttaagttcgtctactagttttaccgngggacctagtccgtacccggggtaggtacccggggtccctacggacccgtagttccgacggcggcgaggtccggggtctaggacgacagtactttcactctaccacctatccgtaacgccgacgtccgtcgaccgacggtactaggaagtagttcgtacggtacgttaagtttacgttacgtacgtcgtacgtacgtagttaagtttacgtaacggttactaccgttacgtacgtttaccggttttcggggacccgggtaaccgtacgtacggttaggacgtaaccgtacggaaaccgtacggtggtacggtcgtaccggacctaaccgtcttacgttaccgttcttacctccggttacccccg

SEQ ID NO: 3554 - DNA, 664 bp, Homo sapiens
  misc_feature: GYAE6OF01BTM7D.39.31.C09.1.454.CMB.1.raw
  modified_base (302)..(302): a, c, t, g, unknown or other
  misc_feature (302)..(302): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagtaattacttcgcttcggtaccagcaacgaaaccaggacacgcctacctaagttgctctatttacgngggcagtccgtacccgggacgtcccggggtccctggaccgtacttcacggcggcgaggcgggtctggagacgagtactttccacttctaccacctatccagccacgccgtcgacgacgggacttacggaagtagtggtacggtacttaagttttaacttacgttggtacctaggtaccttaaggtttaatttaagttaacggttaccgtttacctacgttaacggtttaccgggttttaccgggggaccccggggtaacctagggtaccgtagggtaacgtacgtaaacgaaaccggtacgtggtacggtctaccggacctaacccgtacgttcgttacgttccgttccttacgttaccccg

SEQ ID NO: 3555 - DNA, 770 bp, Homo sapiens
  misc_feature: GYAE6OF01CRO2L.39.31.C09.1.454.CMB.1.raw
  modified_base (308)..(308): a, c, t, g, unknown or other
  misc_feature (308)..(308): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtcctccagactccctggctgtgtctcgtgggcgaggagggcccaccatcaactgacaacgtccagccagagttgtttaacacaggtaccaaacaaataagtaaattacttcgtcttggtaaccagcaacgaaaccaggacagcctactaagttgctcatttacgnggacagtccgtacccgggacggtcccggggtccctggaaccgtattccgacggtccggcgacggtccgggtctaggaacgtactaggtacttttaccgaaccttcctaccaacccgtataccgaacgccgaacgtcccgtagaccgtacgggaccgttaggaaacggtagttcgggtacggtacgtttaacgttttactttaccgtagttaccgaagtaccttaaaggtttaacgtttaaagtttaacggtttaacccgttacccgttaacggttaaccgggtttaacccgggttttttaccgggggaaccccgggggttaaacccgtaacgggtaccggttaagggaaaccggttaaacgtaaaccggtaaaacccggtaacgttcgggtaacggttccgtaaccgtacccgaaccgttaacgttccttaggtttcccttaccgttacccgttaccccccg

SEQ ID NO: 3556 - DNA, 537 bp, Homo sapiens
  misc_feature: GYAE6OF01E2LBD.39.31.C09.1.454.CMB.1.raw
  modified_base (347)..(347): a, c, t, g, unknown or other
  misc_feature (347)..(347): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaacccaggacagcctcctaagttgctcatttactgggcatctacccgggagtccggggtccctgaccgattcagcggcagcggtctganacagactttcgactctcaccatcagcagcctgcaggctgaacgatgtggctaagtttattatgtcagcagttattatagtacgtcctacagtacgttttcgggaccggggtactaacggcttaggagtacgtaccgaaaacggtactaggtcggcctacgccaacctaatctacgtctttcgacttcccg

SEQ ID NO: 3557 - DNA, 886 bp, Homo sapiens
  misc_feature: GYAE6OF01DVMC9.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggcccaccatcaactgcaacgtccagccagagttagtttaccacgacggtaccaaactaaagtaaagtaaatttaccgttcgtacttacggtaaccaagaccaaacgaaaaccgaggacacgtacccttacctaacggttgaccttacttaacgttttaaccgcggggtacctaacgttcccggtaaccccgggggtacgggttccccggggttacccgtaccggtaaccccgttacgttacccgaacgggtcccgggaccgtacggggtccggggttactacgggtaacgaacccgttaaggttaaccttttccgtaacccttccgtaccctaacccgtacgttaccgaccgaacccgtcggtaccccgttagggacccgtaagggtaaccgtaagggtaaagtaggttcggttacggtaccgtttaaagtttttaaccgttaaccgttacggtacgacgttaacgttaagttttaacggtttaacgttacgggtttaccgttacccggttaacgtacccggggtttaaccgggtttttacccgggggaacccgggggttaaacctaccggggttacgttaacgggaaacgttaacccgtaaaccggtaaaaaccgggttcggtttaacgggacggtccggttaccgtaacctacccgttactttcggttacggtttacccctttagtaccccgtttcccccgg

SEQ ID NO: 3558 - DNA, 687 bp, Homo sapiens
  misc_feature: GYAE6OF01D9X0H.39.31.C09.1.454.CMB.1.raw
  modified_base (318)..(318): a, c, t, g, unknown or other
  misc_feature (318)..(318): n is a, c, g, or t
  modified_base (431)..(431): a, c, t, g, unknown or other
  misc_feature (431)..(431): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccagtagttgttttaacacgtacggtaccaaacaaataaagtaatttacttcgtcttggaaccagacaagaaaccaggacacgtacctacgtaagttcgctactatttacgngggacctacgtccggtacccggggtacgtcccggggtccctagaccgattcgacggccggcgacggcggtctggaacgactagtactttcactctacacactcgagccagccngaccgaggtactaggaagtagttaggtaggtacgttaacgttttaagttaccgttacgtacgtagtacgttaagtttaattaacgttaggttaaccttaccgttacggtaacgggttacggttttaccgggggacccggggttaaccgtaagggtcgtacgggtaagtaacgtaaccgtaaaccggtacgttggtaccggtctaccggtactacccgttacttaccgttaccgttaccttaccgtccgttaccccg

SEQ ID NO: 3559 - DNA, 688 bp, Homo sapiens
  misc_feature: GYAE6OF01DNWMQ.39.31.C09.1.454.CMB.1.raw
  modified_base (311)..(311): a, c, t, g, unknown or other
  misc_feature (311)..(311): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgagacgggccaccatcaactgcaagtccagccagtagttgttttaacacacggtaccaaacaaataaagtaattacttcgcttggtaccagacaagaaaccaggacacgcctactaagttcgctctatttacgnggctagtccgtaccgggacggtcccggggtcctaggaccgtattcgacgcggtcgacggtccgggtcgtgaacgacagtacttttaccaccttccactaacccgactcaagccaagtccgtgacgacggctaaggaacgtagtggtacggtacttaacggttttataccgttagtacgtagtacgtagttaattagttaagttaccgtaccttacgtaacggtttacggttttaccggggaaccgggtaaccgtaaggtacggttacgggaacgtaaccgtaaacggtaaaaccggtacgttacgggtacggtaccgtccggtaacccaacccgttacgttaccgttacggtttcccttacgtcccgtttaccccgg

SEQ ID NO: 3560 - DNA, 675 bp, Homo sapiens
  misc_feature: GYAE6OF01CDVUQ.39.31.C09.1.454.CMB.1.raw
  modified_base (235)..(235): a, c, t, g, unknown or other
  misc_feature (235)..(235): n is a, c, g, or t
  modified_base (483)..(483): a, c, t, g, unknown or other
  misc_feature (483)..(483): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctggctgtgtctcgtgggcgagacgggccaccatcaactgacaagtccagccagagttgtttacacaggtaccaaanaataagaattactcgcttggaccagacaagaaccaggacagcctacctaagttcgctactatttacgtggactatccgtacccggagtcccgggtccctgacccgtattcgaggcgacgacggcgggtctaggacgtaacgagtactttaccactctacaacccgtataccgacgaccacgtccctgacgagggtcctaggtaaagacgttggtcggaacttaggtttaactacgtacgtacgaacgntaagttatttaaagtacgttacgtacccttcgtaaacggtttccgttttaacgggggacccccgggaaacgtaacgggcgttagggaaacgttaaaccgtaacgaaaaaccggttaaccgtgggtaaccggtcgttaacggacccctaaacgttagtaccgtttacgtaccgtttcctaacccgtttccccg

SEQ ID NO: 3561 - DNA, 618 bp, Homo sapiens
  misc_feature: GYAE6OF01CI51K.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggcccacatcaactgacaagtccagccagagttgttttaacacgtaggtaccaaacaaataagtaattactcgtcttggtaccagcaacgaaaccagacagcctaccgtaagttcgctactatttacgtcggctactccgtaccgggtacggtccggggtcctgacccgattcagccgcgacggcggtcagagcagtactttacacgtcctcactatcgacgcacgctcgacgaggtcctaaggaagtaggtgtcggtacgttaagttttagtacgtacgtagtacgtacgtaagttattacgtacgtaaccgttcctaacgtacgttaccggtttcggggacccgggtaacgacggtacgtaggacgtaacgtacgaaacggtcgttaggcgtcgtaccgtaccacgtacgttctacgtttctccgttcgttacccc

SEQ ID NO: 3562 - DNA, 804 bp, Homo sapiens
  misc_feature: GYAE6OF01C7C7T.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagacctccctggctgtgtctctgggcgaggacgggcccaccatcaactgacaacgtcccagccagtagttagttttacacacggtaccaaacaaataagaatttacgttcgtcgttaggtaaccaggacaacggaaaacccgaggaaccacgtacccttaccgttaaacgtttcgaccttaccgttaagttttaccgtgggcctaacgtaccggtaccccgggggtacggttccccggggtccctcggaacccgtacgttccgagggccggacgacggtccgggtcgtaggaacgactaagtacttttaccgacctccgtaccaacctacgtaccgaacgtacccgacgtacccgtacggccgtaacgggtacgtaacggtaaacggtacggttacgggtacggttacgtttaaggtttttaactttaccgttacggttaccgacggttacgtaaagttttaacgtttaagttaacggttaaccgtttacccgttaacggttaacgggtttaccgggtttttaccgggggaaccccggggtaacctaacgggtcggtaacggtaacgtaaccgtaaccgtaaaccggtaacgttggtacggtcgtacgtacctaaccgtacttacggttaccgttaccttcgttccttacccccgg

SEQ ID NO: 3563 - DNA, 575 bp, Homo sapiens
  misc_feature: GYAE6OF01EQECV.39.31.C09.1.454.CMB.1.raw
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacagcctcctaagttcgctactatttacgngggctacgtccgtacccggggtagtcccgggggtccctggacccgtattccgagcggcacggtcggtctggacgactagtatttcactctacaccatcagcacgctgcagctagaagtgtgtgtactagtttattactgtcagctagttattatagtacgtcctagtagtacgtttacggggccgggtaacagtcgtaggacgtactaaccgaaacgtacgttggtacggtcttacggacccacgtacttaccttagttacctttcgcgtttacccccg

SEQ ID NO: 3564 - DNA, 728 bp, Homo sapiens
  misc_feature: GYAE6OF01BXAJ0.39.31.C09.1.454.CMB.1.raw
  modified_base (177)..(177): a, c, t, g, unknown or other
  misc_feature (177)..(177): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtcgccgtacggggacatcgtgatcgacccagtcctccagcctccgtggctgtcgtctcgngggcgaggacggccacatacaacgtgacaacgtccagccgagtagtttacgttacacgtacggtaaccaaataaagtaacgtacttacgtcgtcgttacggaccagactaaacgaaccaggacacgtcctacgtaagttcgctatacgtttacggcggacttacggtccggtaaccggggtccggttcccgggtacctacggtaccgtacgttacggaccgggtcggtaccggtagggtaccgggttacgtaacggaaacggtacgtaaacgttactttccgaaccttccgtaacccactaacgtaccggaaccgtcgtaccggtaccgtacgacggtaacggtccggtaagtaacggtagttcggtacgttaacgttaagttacgtacgtacgtaacgtacgtagtagttacgtacgttacgtacttaccgtacgtacggttcggttacgggaccggtacgtacgacgtacggacgaacgttaaacgacggtacgttagggcgtacgaccgtaccgtacttacgtcttaccgttctacgtccgttacccg

SEQ ID NO: 3565 - DNA, 599 bp, Homo sapiens
  misc_feature: GYAE6OF01DXYPZ.39.31.C09.1.454.CMB.1.raw
  modified_base (297)..(297): a, c, t, g, unknown or other
  misc_feature (297)..(297): n is a, c, g, or t
  modified_base (405)..(405): a, c, t, g, unknown or other
  misc_feature (405)..(405): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataaagtaattacttcgcttaggtaccagcaagaaaccaggacagcctcctaagtgctctatttacngggcatcgtacccgggagtcccggggtccctgaccgattcgagcggcaggcgggtctgagacagatttcacttctacaccatcacgcacgcctgacaggactagaagngtggtgtactagtttattactgtcagtctaaggttattatagtacgttcctacgtaggttaccgttttaggggacccggggtaactaaggtccgtagggtaacgtacgtaaccgtaaaaccggtaaactgggtacggtccgtacggtacccaaccgtacttccttaccggtttacctttcctacgttacccccg

SEQ ID NO: 3566 - DNA, 640 bp, Homo sapiens
  misc_feature: GYAE6OF01CX5LI.39.31.C09.1.454.CMB.1.raw
  modified_base (318)..(318): a, c, t, g, unknown or other
  misc_feature (318)..(318): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacgggacatcgtgatgacccagtctccagactccctggctgtgtctcgtgggcgagaggccacatcaactgacaacgtccagccaagtagttgttttaacacgaggtaccaaacaaataaagtaattaccttcgacttacggtaccaagacaagaaaccaggacacgtcctactaagttcgactctaatttacgnggctacgtccgtacccgggacggtcccggggtccctaggaacccgtagttcgacggccgacgacggtccgggttcaggaacgacagtactttcacttcncacatcagcagtcngacgacgcagaagatggtagtacgttagtttatacgtgacgatacaagtttattagtaacgttacgtaccctacgtaacggttacggtttaccggggaccggggtaacacggtacgtacggtaacgaacgtaaccgaaaacgtaccggtggtacggtcctacgccctaacccgtattccgttagttcccttacgtacccgtttaccccg

SEQ ID NO: 3567 - DNA, 612 bp, Homo sapiens
  misc_feature: GYAE6OF01EFFJS.39.31.C09.1.454.CMB.1.raw
  modified_base (249)..(249): a, c, t, g, unknown or other
  misc_feature (249)..(249): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
  modified_base (582)..(582): a, c, t, g, unknown or other
  misc_feature (582)..(582): n is a, c, g, or t
tcagtcgcactagtcacgaccggtgctcgattttagacgtctcatcaaggaaggaaggggcagcaagatggtgttgcagacccgaggtcttcatttctctgttgctctggatctctggtgcctacgggcatcgtgatgacccaggtctccagactccctggctgtgtctcgtgggcgacgagggccacatcaactgcaagtccagccagagttgtttacacgaggtccaaacaataagtaattactcgnttacggtaccagacaagaaaccaggacagcctactaagttnctactatttacgnggcagtccgtaccgggacgtcccggggtcctgaccgtattccgaggtcgcaggcggtcngagacgagtacttcactcgtacaccatcaagtcacgtcctgacgacggactaggaaacgtagtaggtacggtactttaaggtttacttacgtgtccgtaatcgttaagtttacttaagtacgtacgtaccctagtacgttacggtttcgggaaccgggtaacctaggccgtaggaacgtcgtaaacgaaacgtcgttagggcgtacgtacgctaaccctnttacccgttggttccttcgtcgttaccccg

SEQ ID NO: 3568 - DNA, 510 bp, Homo sapiens
  misc_feature: GYAE6OF01DM46U.39.31.C09.1.454.CMB.1.raw
  modified_base (390)..(390): a, c, t, g, unknown or other
  misc_feature (390)..(390): n is a, c, g, or t
  modified_base (434)..(434): a, c, t, g, unknown or other
  misc_feature (434)..(434): n is a, c, g, or t
  modified_base (501)..(501): a, c, t, g, unknown or other
  misc_feature (501)..(501): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagtatttcactctcaccgatcagcagcctgcaggctgaagntgtggactagtttatactgtcagctagtattatagtacgtcctnagtcgtttgggccgggtacaggctaggagatacgaaacgtacgtgtggctgcacgtatactgtcttnacgttcccg

SEQ ID NO: 3569 - DNA, 668 bp, Homo sapiens
  misc_feature: GYAE6OF01DQ6AY.39.31.C09.1.454.CMB.1.raw
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
  modified_base (421)..(421): a, c, t, g, unknown or other
  misc_feature (421)..(421): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccacatcaactgcaagtccagccagagttgttttaacacgacggtaccaacaaataagtaattacctcgtcttggtaaccagacaacggaaaccaggaccacgcctacctaagttcgctactagtttacgngggctactccggtaacccggggacggtcccggggtccctacgaaccgtnttacgacgcggacgacggtcgggtctggaagtacagttacttcactccgtacacctacncgacgcagtcctgcgtacggctagaagtagtggtaggtacttaaggttttattaacgtagtaacgtacgtaagttaagttaagttaacgtacgttaccgtacgttaacggttacggttttacggggacccggggtaacctaaggtcgtagggtaagtaacgtaaccgaaaggtaaccgtcgggtacggtacgacgtacccaaccgtacttccgttacgttacctttccaccgttcccgttaaccccg

SEQ ID NO: 3570 - DNA, 533 bp, Homo sapiens
  misc_feature: GYAE6OF01EJJJQ.39.31.C09.1.454.CMB.1.raw
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaaataagaattacttcgcttggtaccagcagaaaccaggacagcctacctaagttgctcatttactgggcatcgtacccgggagtccgggtccctgaccgattcagcgcagcggtctgagacagatttcactctcaccatcagcagcctgcaggctagaaagatgtgatagtttattactgtcagactagtattatagtagtcctctagtacgtttagggccggggacgaacgcgtaggaagtactacgaaacgtaactaggtacggtcgacgaccaccgtactcgtagttcttcagttccccg

SEQ ID NO: 3571 - DNA, 932 bp, Homo sapiens
  misc_feature: GYAE6OF01CVR3L.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccacatcaactgcaagtccagccagacgttgttttacacacggtaccaaacaataaagtaacttacttcgtcgttggtaccagacaacgaaaccaggacacgcctacctaagttgcctctatttacgtcgggactacgttccgtaacccgggggtacgtcccgggggttccctacggtacccgtagttccgaaggccgggcacgggaccggggttctacggacgtaccgaagttacttttaccgacttaccgtaccgaaccctaagttacccgaaaggaccccgtaaccggtccccggttacgggtacccggtaaccggggtacccgttaagggtaaaacgggtaacggttaacggggtttacggggtaacccgttttaaaggtttttttaaccgtttaaccgtttacgggttacccggtaaagttaacccggtttaaaggttttaacgtttttaacggttaaacggttttaccggttttaccccgtttaccgggttaacgggtttaaacccggtttttttccgggggggaaaccccggggggttaaaccccgtaacggggtaaccggttaacgggggtaaaaccggttaaccgttaaaccgggtaaaaaacccgggttaaaccggttagggggttaaccgggttccccggttaaccgggtaaaccccgttaacccccggttaaacgttttaccccggtttacccggttttaaccccttttacccggttaaccccgttttaccccccccggg

SEQ ID NO: 3572 - DNA, 526 bp, Homo sapiens
  misc_feature: GYAE6OF01EJJP9.39.31.C09.1.454.CMB.1.raw
  modified_base (294)..(294): a, c, t, g, unknown or other
  misc_feature (294)..(294): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttcgctctatttacngggcatccgtacccggggagtcccggggtccctgaccgattcgaggtggcaggcgggtctgagacagtatttcactctcaccatcagcagcctgcaggctagagtgtgngnttagttctacgtgcgtgatattatatagtctctagtagttacggttcgggacggacagtcgtagagtacaacgaacgtagtggcggctacgaccactctcgtgttcttcgtccgttccccg

SEQ ID NO: 3573 - DNA, 657 bp, Homo sapiens
  misc_feature: GYAE6OF01BI0RW.39.31.C09.1.454.CMB.1.raw
tcagtcgcactagtcacgaccggtgctcgatttagacgtctcatcaaggaaggaaggggcagcaagatggtgttgtagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaaacaataagaattacttcgcttggtaccagcaacgaaaaccaggacagcctacctaagttgctctatttacgtgggcagttccgtacccggggacggttcccggggtccctggacccgtattcgaggcggcacggcgggtctagagacagtactttcacttctaccacctatcagcaacgtcctgcgaggtacctaggaagtagtggtaggtacgttaagttttacttacgttagtaccgagtacttaagttaactttaagtagttaacgttccttacgtacggttacgttttacggggacccggggtaacaaggtcgtaacgggagtaacgtaaccgaaaaccggtacgtcgggttacggtacctcggtaccctaacctaacgtttccgttacggttaccctttactaacccgtttcccgttacccccgg

SEQ ID NO: 3574 - DNA, 683 bp, Homo sapiens
  misc_feature: GYAE6OF01CRUHF.39.31.C09.1.454.CMB.1.raw
  modified_base (301)..(301): a, c, t, g, unknown or other
  misc_feature (301)..(301): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgcaagtccagccagagttgtttacacaggtaccaacaataagaattactcgcttggtaccagacaagaaaccaggacacgcctcctaagttgctactatttacgnggactagtccgtacccgggacgtcccggggtcccacggaccgtacgttcgacgcgggaccagggtccgggtactaggaagaccagttactttccgacttccgtacacctatacgacgctacgcccgtgaccgtagggctaggaacgtacttggtacggtacttaaggttttactacgttagtcgaagtacttaacgtttaattagttaacgtacgttacctacggtaacgttaccggttttacgggggacccgggtaacctagggtaccgtagggtaacgtaacgtaaccgtaaaaccggtcgttacggggtaccgtccggtacgtaccgtaacccgtactttacccgttacgtttaccgtaccgttaccgtttacccccgg

SEQ ID NO: 3575 - DNA, 587 bp, Homo sapiens
  misc_feature: GYAE6OF01EC19D.39.31.C09.1.454.CMB.1.raw
  modified_base (297)..(297): a, c, t, g, unknown or other
  misc_feature (297)..(297): n is a, c, g, or t
  modified_base (384)..(384): a, c, t, g, unknown or other
  misc_feature (384)..(384): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacagtccaacaataagaattacttcgcttggtaccagacaagaaaccaggtacagcctacctaagttgctactatttacngggctagtccgtacccgggagtcccggggtccctgaccgtattcgacgtcggcacggcgggtctgagacagtactttcactctcacntcagcagcctgcgaggctgaagtatggtagtactagtttactacgtgtcagtctaagttattagtagttacgtcctacgtacgttacggtttcgggaccggggtaacacggtcgtaggaacgtagtaacccgaaacggtacgttaggtacggtacgtacgacctaaccgtacttacgttacgttaccttcgtacgttaccccg

SEQ ID NO: 3576 - DNA, 765 bp, Homo sapiens
  misc_feature: GYAE6OF01DMERI.39.31.C09.1.454.CMB.1.raw
  modified_base (335)..(335): a, c, t, g, unknown or other
  misc_feature (335)..(335): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagacgggccacatcaactgcaagtccagccagtagttcgtttacaacgtaggtaccaaacaaataaagtaatttaccttcggtacgtttaggtaaccaacggacaaggaaaaccgaggaaccacgtacccttactaagttcgacttactattttaaccgngggacctacgtaccgtacccggggtacggtcccggggtccctacggaccgtgttaccgaggtccggacgaggtccggggttactacggaacgtacaaggttacttttaccgacgttacctaccgaaaccctagtaccgacgccgacggtcccgtggaccgagggtcctaagaagtacgttggtacggtacgtttagtttaacgttacgttacgtacgtacgtacgtaagttaatttaacgttaaggttccgttacccttacggtaacggtttacgggttttacccgggggacccggggttaacctacgggtaacggttacgggaagtaccggttaaacgtaaaaccggttaacgtacgggtacggtaccgtaccggtactaacccgtacgtttaccgttacggtttacccttacgtacccgtttaccccg

SEQ ID NO: 3577 - DNA, 637 bp, Homo sapiens
  misc_feature: GYAE6OF01B1KSB.39.31.C09.1.454.CMB.1.raw
  modified_base (312)..(312): a, c, t, g, unknown or other
  misc_feature (312)..(312): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccagtagttgttttacacgacggtaccaaacaataaagtaatttacttcgcttaggtaccagacaagaaaccaggacacgcctacctaagttcgctctatttacgnggctagtccgtaccgggcggtcccggggtcctcggacctagttcaggccgcgacggcggtacagagacgtagtatttcactctaccacatcgacgcacgtcctgcgaggctaggaagtgtggtagtacttagtttacttacgtcgttacgaaggtactaagttagtttaagtaacggttacgtacccgttacgtaacggtttacggtttaccggggacccggggtaacctaggtcgtaggaacgtacgtaaaccgtaaaccggtagttcggacggtctacggacctaccgttacgttcgttagttaccctttcgtccttcccccg

SEQ ID NO: 3578 - DNA, 647 bp, Homo sapiens
  misc_feature: GYAE6OF01DE91D.39.31.C09.1.454.CMB.1.raw
  modified_base (315)..(315): a, c, t, g, unknown or other
  misc_feature (315)..(315): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgagagggccaccatcaactgcaagtccagccagagttgttttaacacgaggtaccaaacaaataaagaattacttcgtcttaggtaccagacaagaaaaccaggacacgcctaccgtaagttgactctaattttacgngggactactccgtacccggggacggtcccggggtccctggacccgtattcgaggcggtcagggccgggtctaggacgacagtatttccactctcaaccatcagccacgcctgacgagctagaacgtagtgtggacttagtttattacgtgtacagtactaagttaatttagtaagttcgtaccgtcgtaacgggttaccgttttacgggggacccggggtaactaacggcgttaagggaactaacgtaacgaaaaccggtacgttcgggtacggtaccgttacggaccctaaccgtacgttcgttacggttacctttccgtactttcccccg

SEQ ID NO: 3579 - DNA, 794 bp, Homo sapiens
  misc_feature: GYAE6OF01EG34W.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggacggaccaccatacaactgacaacgtccagccagtagttagtttaacacgaggtaccaaactaaataaagactttacgttcgtacgttacggtaaccagacaacgaaaaccgaggaacacgtacctacgtaaagttcgctactactttacgtggactaacgtaccggtacccgggtacggtcccggggttccctacggtaaccgtacgttacgacggtaccgggacgtaacggtcgggtaccgtaggaacgtacggtaaggttaacctttaccgaaccgttcccgttaccaaaccccgtagttacccgaacggaccgttaacgccccgttaggaccgtaacgggtacgtaaggtaaagtaaggttcggtacggtacgttaaaggttttaacgttacgtacgtacgtaacgtacgttaaggttaatttaagtacgttaacgtaccgttacgtaacgggtttaccggtttaccgggggaaccggggtaaaccgtaaggtacggtaacgggtaaccgtaaacgtaaaccggtaaaacggtacgtacgggttacggaccttaccgaacccgtaacccgtacttccgttacgttcctttaaccgccgtttacccccgg

SEQ ID NO: 3580 - DNA, 734 bp, Homo sapiens
  misc_feature: GYAE6OF01C69QZ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatgacccagtctccagactccctggctgtgtctcgtgggcgagacgggccaccatcaactgcaagtccagccagagttgtttacacacggtaccaaacaataaagtaacttacttcgtcgttacggtaaccagaccaaacgaaaaccgacggaacctacgacccttaccgttaaacggttcgacctcttaacgttttacggtcgggactacgtacccggtacccggggtaaccggtccccggggtcctacgaccgtattccgacggtccgggcacggtcgggtactggaggactagttactttccacctcctacccaccgtactccgaagccgacgtcccgtacgacgacggtctaagaagtagtaggtcggtacttagtttacttacgtcgtacagtacttaagttaatttagttaacggttacgtaccgttacgtaaccgggtttacggttttaccgggggacccgggggtaaccgtacggtacggttacggtaaacgtaacgtaaaccggaaaaccggttaacgtacgggttacggtaccgtcggtaaccctaccggtaacttccgttagttcccttacgtcccgtttaacccccg

SEQ ID NO: 3581 - DNA, 669 bp, Homo sapiens
  misc_feature: GYAE6OF01EXG4N.39.31.C09.1.454.CMB.1.raw
  modified_base (219)..(219): a, c, t, g, unknown or other
  misc_feature (219)..(219): n is a, c, g, or t
  modified_base (438)..(438): a, c, t, g, unknown or other
  misc_feature (438)..(438): n is a, c, g, or t
tcagtcgcactagtcacgaccggtgctcgatttagacgtctcatcaaggaaggaaggggcagcaagatggtgttgcagacccaggtcttcattttctctgttgctctggatctctggtgccgtacggggacatcgtgatgacccagtctccagacctccctggctgtgtctcgtgggcgagagggccaccatcaactgacaagtcccagccagtagttnttttaacacgtaggtaccaaaacaaataaagtaaactttacttccgcgttacggtaaccagacaaacggaaaaccagggaaccaggtaccctacgtaaagttcgctactaagtttcgagggctacgtaccggtacccgggtacgtcccgggtcctacgaccgtattcgacgcgcgagtcggtctgacgactagtactttcactcctacgactatacgancgacgctcgacgacggcgtaggaacgtagtggtagtacttaggttttacttctcgtaacgagtactaagtttatattagtcgttaccgttacgagttacggtttacggggacccgggtaacaacgggtccggtaaggtacgtaaacgtaaccggaaacgtaacgttgggtcgtaccggtgaaccctaacgtacgttccgttaagtttccgttaaccctcgtttacccccgg

SEQ ID NO: 3582 - DNA, 537 bp, Homo sapiens
  misc_feature: GYAE6OF01B75QY.39.31.C09.1.454.CMB.1.raw
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (525)..(525): a, c, t, g, unknown or other
  misc_feature (525)..(525): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcaagaaacccaggacagcctcctaagtgctcatttacngggcatccgtaacccggggngtcccggggtcccngaccgatcacgcgcaggcgggtcngagacagtatttcactcncaccatcagcacgctgcaggctagaagatggtggcttaagtttacttactgtacagtctagttattagtacgtacgtacctcgtagttacgtttcgggaccggggtaacacggtcgtaggagactacgaaacgtacgtggtggctagcacctatctnttcttcattccc

SEQ ID NO: 3583 - DNA, 664 bp, Homo sapiens
  misc_feature: GYAE6OF01B6F7Z.39.31.C09.1.454.CMB.1.raw
  modified_base (438)..(438): a, c, t, g, unknown or other
  misc_feature (438)..(438): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagtagttgttttacacacggtaccaaacaataagtaattactcgtcttaggtaccagcaagaaaccaggacacgcctactaagttcgctctaatttactgggactactccgtaccccggggacggtcccggggtccctacggaccgtattcgacggccggcgagggccggggtctaggacgacgagttactttaccgaccttcgtaccacactacacgacacgcctgacgnggtactagaagtatggtacggtacgtttaagtttactacgttgtacaggacttaagttacttaagtagttaccgtcccttagaaccgggttttacgggtttaccggggacccggggtaaccgtaagtaccggttacggtaaagaccgtaaaccgtaaaacggtacggttagtcgggtaccaccggtacctaaccgtacttccgttacgttctccgtcgttccccgg

SEQ ID NO: 3584 - DNA, 726 bp, Homo sapiens
  misc_feature: GYAE6OF01CN00N.39.31.C09.1.454.CMB.1.raw
  modified_base (364)..(364): a, c, t, g, unknown or other
  misc_feature (364)..(364): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagtgttttacacaggtaccaacaaataagaattacttcgcttggtaccagcaagaaaccaggacacgccctacgtaagttgctctatttacgtggacataccgtacccgggagtcccggggtccctgaccgattcacggcggacaggtccggtcgngaacgtacgaacgttatttcccacttacctctaaccctaagttccgaacggccaacggtcccgtacggaccgtacggacgttaacggaaagtaacgttggttacggtaaccgtttaggtttttaacctttacgttaccggttacgtaacggtaccgtaaggttttaattaacggtttaacgttaacggttacccgttacttaacggggtttacggtttttaccggggaccgggggtaaaccaggttacggtagggtaactacggtaaacgaaaaccggtacgttacgggtacggttacgtccgtaacctacccgttacggttaccttcccggtttacttacccggttacctttaccccccgg

SEQ ID NO: 3585 - DNA, 645 bp, Homo sapiens
  misc_feature: GYAE6OF01DOYD5.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagagggccaccatcaactgcaagtccagccagagttgtttacacagtaccaaacaataagaattactcgcttggtaccagcaagaaaccagacagcctactaagtcgctctatttacgnggactagtccgtaccgggacgtcccggggtcctgaccgattcgacgcggcaggcggtctagacgacagtactttcactctacaccatacgacgacacgcctgcgaggtcgtaggaacgtagtggtcgtattaagttttacttacgttgtacaaggtaccttaaagttaatttaacgttaacggttaacgttacccgttacgttaacggttaccggtttttaccggggacccggggtaacctaaggtaccggttaggaacgtaacgtaaaccgtaaaacggtacgttacgggtacgtcgttaccggacctaacccgtattaccgttagttccttaccgtccgtttacccccg

SEQ ID NO: 3586 - DNA, 628 bp, Homo sapiens
  misc_feature: GYAE6OF01BAP2X.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagaggccaccatcaactgcaagtccagccagagttgttttacacaggtaccaacaataagaattacttacgcttaggtaccagcagaaaccaggacacgcctacctaagtgctctatttactggcatccgtacccgggagtcccgggtcctaggacccgtattccgagtcggaccacggccgggtctgaacgacgagtacgtttcaactcctaccaccagttacacgcacgtcctggccgtaaggctaacgaaaggtatcggtcggtacttaaggttttactaaccgttgtaccgagtaccgtaagttactttaagttacgtaccgttacctacgtaacgttacggttttccggggaccggggtaactacggtccgtaggacgaacgtaaccgtaaaacggacgtagtcggtacgtcgaccgacgtcttaccgtagttccttcgtcttaccccg

SEQ ID NO: 3587 - DNA, 733 bp, Homo sapiens
  misc_feature: GYAE6OF01BVZAA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtcgccgtacggggacatcggtgatcgacccagtcctccagacctccgtggctgtgtctcgtgggacgaggacggaccacatacaactcgactaacgcacgcagtacgttacgtttacacgtacgtaaccaaactaaagtaacgtaacttacgtcgtacgttacggaccagacaacgaaccgagacacgtcctacgtaagtcgtctcgtattacgcggactacgtaccggtaccgggtcggtcccgggtacctacgaccgtactacgcggccggacgacgggtccggtcgtaggaacgacgtacgttactttacaccgttctacccactactacgaacgccgcgtacctcggacgtacggtacgtaaggaagttaggtacggttacgttaacgtttaagtttacttaggtcgtaacgtacgtacgttaactttaagttacgtacgttaccgtaccgttaacgtaccgggttttaccgggttaccgggggaacgttaaccggtagtacggttaaggaaccgtaaaggttaaacccggtaacgggtacgttcggggtacgtccgtaaccggtaccttaacgtcgttttcccgtactttcccttagtccccggttaccccg

SEQ ID NO: 3588 - DNA, 881 bp, Homo sapiens
  misc_feature: GYAE6OF01DOH71.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgagacggccaccatcaactgacaacgtccagccgaagtagtttcgttttaacacgacggtaccaaacaaataaagtaacttacgttcgtacttacggtaaccagacgaacgaaaaccgaggaacacgcctacgttaagttcgcctacgtaacgtttacgtcgggacctacgttacccgtaacccggggtccggttcccggggtaccctacggaaccgtacgttaccgaacggccggaccgacgggtccgggtaccgtaggaacgtaacgagttacctttaccgaccttacctaccaaccgtacgtaccgaacgtacccgacgtacccgttacggaccggtacggtaccgttaaggaaacgttacggtttacgggtacggttaccgttttaaacggtttttaacttaacccggttaggttaaccgtaacggttaaccgttaaaggttttaacttttaaagggttaaaccggtttcccgttacccctttaacgggttaaccgggttttaacccggggtttttaaccggggggaaccccggggtaaacccttaacgggtacggttaaccgggtaaacgtaaacccgttaaaaccgggtaaaaccgtaacgggttgggtaccggttacccgtacggtaccccgtaaacccgtttaacgttcccggttaacggttttcccttaaaccgttccgttttaacccccccgg

SEQ ID NO: 3589 - DNA, 724 bp, Homo sapiens
  misc_feature: GYAE6OF01DC1LY.39.31.C09.1.454.CMB.1.raw
  modified_base (333)..(333): a, c, t, g, unknown or other
  misc_feature (333)..(333): n is a, c, g, or t
tcagtcgcactagtcacgaccggtgctcgatttagacgtctcatcaaggaaggaaggggcagcaagatggtgttgcagacccaggtcttcatttctctgttgctctgatctctggtgccgtacgggacatcgtgatcgacccagtctccagacctcccgtggctgtgtctcgtgggcgagacggccaccatcaactgacaacgtccagccagtacgttacgttttacaacgtacggtaccaaacaaagtaacgtaatttacttcgtcgttaggtaaccgagaccaacgaaaccgacggaacacgtcctaccttaagtcgctactactttacgnggacacgtaccgtacccgggtacggtcccgggtcctacggaccgtacgttacgacggcggacgacggtcgggtcgtagacgaacagttaacgtttccaccgttacctaccgtaccatccgaacgtccgacgtcccgtcgaccggaacggtcttaaggaaacgttaggtttcggtacgggttaacgtttagtttttacttaccgttcgggtacacggttacgttaattaacgtttaagttacgttaccgttacccgttaacgttaccgggtttaccggggtttacggggaccccgggtaacgtacgtacgggtaaggacgtaaacgtacgaaaaccggtcgtagggtccgcgttacgacctacgtactcttactacctcgttaccgtccccg

SEQ ID NO: 3590 - DNA, 748 bp, Homo sapiens
  misc_feature: GYAE6OF01CFJUC.39.31.C09.1.454.CMB.1.raw
  modified_base (489)..(489): a, c, t, g, unknown or other
  misc_feature (489)..(489): n is a, c, g, or t
  modified_base (503)..(503): a, c, t, g, unknown or other
  misc_feature (503)..(503): n is a, c, g, or t
  modified_base (575)..(575): a, c, t, g, unknown or other
  misc_feature (575)..(575): n is a, c, g, or t
tcagtcgcactagtcacgaccggtgctcgatttagacgtctcatcaaggaaggaagggacagcaagatggtgttgcagacccagtcttcatttctctgttgctctggatctctggtgccgtacgggacatcgtgatcgacccagtctccagtacctcccgtggctgtgtcctcgtgggcgaggacgggcccaccataccaactcgacaacgtccacgaccagtagtttacgtttaacacgtacggtaaccaaacaaagttaaagtaactttaccgttccgtacgttacggtaacccagaccaaacggaaaccaggaacctacgtaccttaccgtaagttcgacctagttacgttttacggcggacctacgttcccggtaacccggggtaccggttccccggggttacccacggtaccgttacgtaccgacggccggtaccgcgggtaccggtactaggaacgaacgtagttacttccacctcaccaccnctacacgtccgacncccgtacgacgacggtacctaaggaacgtaggttcgggtacgtaaccgtttaggtttactacgtcgtaacgngtaacttagttattaagtacgtttactacccgttagtccgggtttaaccggtttccgggggaacccggttacagggtcgtaacggaactaaccggtaaacgtaaacggtcgtcgggtaccgaccgtaccgtcctaccgttacttacggttaccttcctcgttacccttccccg

SEQ ID NO: 3591 - DNA, 772 bp, Homo sapiens
  misc_feature: GYAE6OF01DG34L.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaacaataagaatttacttcgcttacggtaccagacacgaaaaccaggacagcctactaagttcgactctaatttacgtgggctaattccggtacccgggtacggtcccggggttccctacgacccggtattaccgacggtccggacgaacgggccggggtttactagggaacgaaccgtaaggttactttttacccaaccttcccttaccaaacccgtaattccgaaacgtccaacggtccccgtaggaccgtaacgggtacgttagggaaaacgtacgttaggggttcggactttaaaggttttaacttaacgtcgtaaccgtagtaccgtaaggttttaactttacgttaacggttaaacgttccccgttaaggaaccgggtttaaccgttttacgggggggacccccggggtaaacaaacgggttccgttaaaggggaaacgttaacgttaaacccgggaaaaaccggtacgtttagggtaccggtacgtacgtaccctaaccctacgtttccgtaagtttcccgttactccgtttacccccg

SEQ ID NO: 3592 - DNA, 570 bp, Homo sapiens
  misc_feature: GYAE6OF01EC1OH.39.31.C09.1.454.CMB.1.raw
  modified_base (443)..(443): a, c, t, g, unknown or other
  misc_feature (443)..(443): n is a, c, g, or t
  modified_base (541)..(541): a, c, t, g, unknown or other
  misc_feature (541)..(541): n is a, c, g, or t
  modified_base (563)..(563): a, c, t, g, unknown or other
  misc_feature (563)..(563): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccacatcaactgcaagtccagccagtagttcgttttacacaggtccaaacaataagaattactcgcttgtaccagacaagaaaccagacagcctacctaatgctctattactggactagtccgtacccgggacggtcccggggtcctcgaccgtattacgacgtcggacgaggtccggggtactgaacgactaggtactttcactctacacatcaagcacgctgcaggctagaagtagtgtagtagtagtttacttacgtntcagtctaagttattagtagttaacgtcctacgtacggttacgtttccgggaccgggaccagtcgtaggaactagacgaaaacgtacgtgtacggtcncgcaaccgtatcttatcttacnccttacc

SEQ ID NO: 3593 - DNA, 758 bp, Homo sapiens
  misc_feature: GYAE6OF01DUUVD.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagacggccaccatcaactgcaagtccagccagtagttgttttacactacggtaccaaacaaataagtaactttacgttcgtcgttaggtaccagacaacgaaaccaggaccagcctactaagttcgctctatttacgcggactacgtccggtacccggggtacggtcccggggttccctacggtaacccgtacgttccgacggtccgggaccgtacgggtccggggttacctaggaacgtaacgtaacggttaacttttaccgaaccttcctaccaacccgtagtaccgaacgaccgtaaccggtcccgtacggaccgtaacgggtccgttaaggtaaaggtaagttacgggttacggtacgttaacgttttaacgttaccgttacgttacgtaacgtacgttaagtttaatttaagttaacgttacgttaccttacgtaacggttacggttttaccggggaccggggtaaccgtacggtacggtacggaacgtaacgtaaccgtaaacggtaacgttaggtacggtacgtaccgacgtacccgtagttacccttacgtttccttcgtacctttaccccgg

SEQ ID NO: 3594 - DNA, 794 bp, Homo sapiens
  misc_feature: GYAE6OF01ED77G.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctcccgtggctgtgtctcgtgggcgaggacgggccaccatccaactgacacgtccagccagtagttacgtttacacgtacggtaccaaacaaataagtaactttacttcgtacgtttcggtaaccagacaacgaaaccgacgacacgtccttaccgttaagttcgaccttactacttttacggcgggtactacgtacccggtacccggggtacggtccccggggttccctacggtaccgtacgttaccgacggccggtacgtacgggtcggttactaggacgtacgtacgttactttccgacttccgtacaaccgactacgacgtccgtacgtccgtagtaccggtaaggtccgtaaggtaaacgttgtaccggggttacgtagttttaacggttttattaccggtacgttaaaccgtaagttaacgttttaagttaagttaccggtaaccgtttaccgttaacgttaccggggttttaccgggtttacccggggggaacccgggttaacgacggttaccggtaagggaaccttaaaccggtaacggtaaaaccggtcggttaggtaccggtacctccgtaacccgtaatttacccggttcttacgtttaccctttacgtaccgtttcccccgtaacccg

SEQ ID NO: 3595 - DNA, 614 bp, Homo sapiens
  misc_feature: GYAE6OF01A5IT8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagtgctcatttactgggcactctacccgggagtccggggtcctgaccgattcgagcggcgaggcgggtctgagacagtactttcactctcaccatcagcagcctgcaggctagagatggtggctaagttttatacgtgtaccagtctaagttattaacgttagtaacgttcccttacgtaacggttaccggtttttacggggacccgggggtaaccctaaggtccgttaggggaacgtaaacgtaccgtaaaacggtaccgttagggttacgggccgttaccggtaccctaacccgtattcccgttacggtttccctttacgtaaccgttttcccccg

SEQ ID NO: 3596 - DNA, 812 bp, Homo sapiens
  misc_feature: GYAE6OF01DDJN8.39.31.C09.1.454.CMB.1.raw
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggacgggcccaccatccaactgacaacgtccagccagtagttgtttaacacgtacggtaccaaactaataagtaattacttcgtcttaggtaccagacagaaaccaggacacgcctactaagttnctactattacgnggactacgtccgtacccgggacggttcccggggtccctacggtaccgtacgttaccgaggaccgggcgtacgggtccggggttactaggaacggtaaccgtaaggttacttttaccgaaccgttaccttacccaaaccctacgtaaccgaacggtaccgtaaccggtcccgtcggaccgacgggtaccgttaaggaaacggtacgttcgggtaacggtaaccgttttaagttttaaccttacggttacgtaccgtaacggtaacttaaaggttttaactttaacgttaacggtttaccgttaacccgttacggtttaaaccgggttttaacccggggttttaccggggggaaccccggggttaaaccacgggtacggttaacgggaacgtacgtaaaacccgtaaaacgggtacgttgggaaccggttcgtacccgaacccttaaaccggttcgttacttacccggtttacctttcccgtaaccgtttacccccggg

SEQ ID NO: 3597 - DNA, 742 bp, Homo sapiens
  misc_feature: GYAE6OF01D8QY2.39.31.C09.1.454.CMB.1.raw
  modified_base (730)..(730): a, c, t, g, unknown or other
  misc_feature (730)..(730): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcggtgatcgacccagtcctccagacctcccgtggctgtgtctcgtgggcgaggacgggccaccatccaactgacgaagtccacgccaaggtagttacgtttaaccacgtacggtaccaaactaaataaagtaacttaccttacgtcgttacggtaccaacgacaaacgaaaccgaggacgacgtcctaacgttagttcgcctactacgtttacggtcggtactaccggttacccggtacccggggtcggtaccccggggtccctacggtaacccggtacttccggacggccgggtacgaacgggtccggggtactaggaacgtaacgtacggttacctttaccgtaacgttccctaaccaacccgtagtacgaccgtcgacccgtcgtcgacggtacgtacgtaaggtaacgtgtcggtacggtacttaagttttactacgtcgtatacgtctaagtttacgtagttacgtacgtttaccgtaggtacggtttaccgggttaccggggaccgggaactaggtcgtagggacctaaacgtaaccgaacggtacggtggtacggtactacggtaccaccgttctacgttatcccgttacnccgtttaccccg

SEQ ID NO: 3598 - DNA, 626 bp, Homo sapiens
  misc_feature: GYAE6OF01AXMCU.39.31.C09.1.454.CMB.1.raw
  modified_base (295)..(295): a, c, t, g, unknown or other
  misc_feature (295)..(295): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacgaggtaccaacaataagaattacttcgcttggtaccagcaagaaaccaggacagcctcctaagttgctcatttacngggctagtccgtacccggggacggtcccggggtccctacggaccgtacttccgaggccggcgacggtcggggtctggacgacaggtatttaccacttcctcaccattccagtaccacgcctgacgtacggactaggaaacgtagtcggttaggacttaagtttacttactgtctaagtcctaagttattaacgttagttacgtccttagtaacgttacggtttaccgggacccggggtaacacgggtactagggtacgaacgtaccggaaagtaccgtggtacggtccgtacgacccgtactacgtactacgttacccttgtccttacccg

SEQ ID NO: 3599 - DNA, 797 bp, Homo sapiens
  misc_feature: GYAE6OF01CJ1C0.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtcctccacgacctccccggctgtcgtctcgtgggcgaggacggcccaaccactaccaaactcgacaaacggtaccaagacccaagtacggttacgttttaaccaacgtaacggtacccaaaaactaaattaaacggtaaactttaaccgttccgtacgtttacgggtaaccaggaccaaacggaaaccgaaggaaccacgtacctaccgttaagtcgactactaacgtttacgtcgggaccactaccggtacccgggtaccggttcccgggtccctacgtaaccgtaacgttaccgacggtccgggacgtacgggcggtacgtagaacggacgtaacgtacttaccaacttacctactaacccataccgacgacgaacgtcgtacgacgacggacgttaagaagtacgtacggttacggtactttaaagtttacttacgtacggtacgtaacgtacgtaattaacgtttaagtaaccggtttcgtaacccgtacggttacggtttacccgggttaaccggggtaccggggttaacgaacggttacgggaacggtaaagtaaccgttaaaccggaacgtaacgggttcggacgtacgtaccggacctaacgtttacgtcgttaccttcgttacctacccgtcccgttaacccg

SEQ ID NO: 3600 - DNA, 603 bp, Homo sapiens
  misc_feature: GYAE6OF01EQ2IM.39.31.C09.1.454.CMB.1.raw
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
  modified_base (362)..(362): a, c, t, g, unknown or other
  misc_feature (362)..(362): n is a, c, g, or t
  modified_base (410)..(410): a, c, t, g, unknown or other
  misc_feature (410)..(410): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttttacacaggtccaaacaataagaatttacttcgcttggtaccagcagaaaccaggacagcctacctaagttcgctctatttcngggcagtcgtacccgggngtcccgggtccctgaccgtattcgagcggcagcggtctgagactagntttcactctacaccatcagcacgcctgcaggctagaagtactggtcgngttagtttattacgtgtacgagtacgtaagttactttagtacgttacgttacctacgttaggtttaccggttttcggggacccgggggtaacctaaggtccgtagggaacgtacgtaaccgtaaacggtaccgttaggttacggctacggacctacgtacgttccgttagtttcctttcgaccgtttaccccg

SEQ ID NO: 3601 - DNA, 599 bp, Homo sapiens
  misc_feature: GYAE6OF01EPYLO.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctactatttacngggcatccgtacccgggagtcccggggtccctggaccgattcgagcggcacggcgggtctagacgacagtactttcacgtctcaccatcagtcacgtcctcgcaggctagaagtacgtaggtcggacgttaagttttattacgtgtcagtctaagttattagtacgttacgtcctacgtaacgttacggttttacggggaccggggtaacctaaggtcgtagggaagtacttaaacgaaaccgtaacgttggtacggtctacggaccaaccgtacttacgttacgttccttctccgtttaccccg

SEQ ID NO: 3602 - DNA, 640 bp, Homo sapiens
  misc_feature: GYAE6OF01D4EVA.39.31.C09.1.454.CMB.1.raw
  modified_base (320)..(320): a, c, t, g, unknown or other
  misc_feature (320)..(320): n is a, c, g, or t
  modified_base (448)..(448): a, c, t, g, unknown or other
  misc_feature (448)..(448): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctcccgtggctgtgtctcgtgggcgagacgggccaccatacaactgacaagtccagccagtagttacgttttacacgtacggtaccaaacaaataagtaattacttcgcttaggtaccagacaacgaaaccgaggacacgtcctactaagttcgactctatttacgnggctacgtccgtacccggggacggtcccggggtcctacgaccgtattcgacggtcgcgaggccggtatagacacgagtactttcacttccacaccatcagcacgcctgacgagcgtagaagtagtggnggtacttagtttacttacgtcgtacagtactagttattaagtacgtacgttacctacgtacggttaccggtttacggggaccgggtaaccgtacggcggtaggaacgtacgtaaccggaaacggtacgttaggtacggtcgtacgacccgtaaccttacgttaccgttagtttccttccttccgttaccccg

SEQ ID NO: 3603 - DNA, 650 bp, Homo sapiens
  misc_feature: GYAE6OF01BEPIO.39.31.C09.1.454.CMB.1.raw
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (419)..(419): a, c, t, g, unknown or other
  misc_feature (419)..(419): n is a, c, g, or t
  modified_base (480)..(480): a, c, t, g, unknown or other
  misc_feature (480)..(480): n is a, c, g, or t
  modified_base (509)..(509): a, c, t, g, unknown or other
  misc_feature (509)..(509): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatggacccagtctccagacctccctggctgtgtctcgtgggcgaggagggccaccatcaactgaccaacgtccacgccgagtagttgttttaacacacggttaccaaactaaataaagtaatttacttcgtcgttacggtaaccagacaacgaaaaccgaggacacgcctaccttagtttctctatttacgtcggactactccggtacccgggtcggtcccggggtccctcggaccgtacgttcacggcggcgnggcgggtcngagacagtacttcacttccncacatcagcacgctacgcaggtacgtagaagacgttggtacggtattagtttacttcgtanacgtagtactagttacttattaaggttcnccgttacgtagttaccggggtttcgggaaccgggtacagggtcgtaaggtaactacgtaaacgaaacggtcgtacggtggttacgtcgaaccggtacctgttacccgttatttaccccgtttactcccgtttcctaccccg

SEQ ID NO: 3604 - DNA, 667 bp, Homo sapiens
  misc_feature: GYAE6OF01AQ3X2.39.31.C09.1.454.CMB.1.raw
  modified_base (298)..(298): a, c, t, g, unknown or other
  misc_feature (298)..(298): n is a, c, g, or t
  modified_base (367)..(367): a, c, t, g, unknown or other
  misc_feature (367)..(367): n is a, c, g, or t
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctacctaagttcgccctatttacgngggctagtccgtacccgggagttcccggggtcctgaccgtattcacggcggcacggcgggtctacgganaccgagtactttcactctccacctatcacgcacgtcctcgcgacggcgtagaacgagttggtacggtacgttaagttttacgttacgttcggtactacgtctaagttaactttagtacgttacgttccgtacgtacggttaccggttttacggggacccggggtaaccgtaaggtaccgttacgggtaaggacgttaaccggtaaaaccgtaacgttacgggtacggtacgttaccggaccgtaacccgttacgttaccgttacgttacccgtttaccttccgttaccccgttaccccgg

SEQ ID NO: 3605 - DNA, 633 bp, Homo sapiens
  misc_feature: GYAE6OF01BU2KG.39.31.C09.1.454.CMB.1.raw
  modified_base (301)..(301): a, c, t, g, unknown or other
  misc_feature (301)..(301): n is a, c, g, or t
  modified_base (414)..(414): a, c, t, g, unknown or other
  misc_feature (414)..(414): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagagttgtttaacacacggtaccaaacaataagaattacttcgcttggaccagacaagaaaccaggacagcctactaagttgctctatttacgngggctagtccgtacccggggacgttcccggggtccctggacccgtattccgaggtccggacaggcgggtctagaacgactagtactttacaccttctaccaccatccacgacncgtaccgtgacgacggacgtagaagtgtaggtgtacgttagtttacttacgtgtacagtctaagtttacttaagtcgttacgtaccttacgtacggttaccggttttacggggacccggggtaccacggtcgtagggtaactaagtaacccgtaaagtaacggtggtacggtccacgacctacccgtagttcccttacgtttcttcccgtgttcccccg

SEQ ID NO: 3606 - DNA, 658 bp, Homo sapiens
  misc_feature: GYAE6OF01C1S1N.39.31.C09.1.454.CMB.1.raw
  modified_base (302)..(302): a, c, t, g, unknown or other
  misc_feature (302)..(302): n is a, c, g, or t
  modified_base (315)..(315): a, c, t, g, unknown or other
  misc_feature (315)..(315): n is a, c, g, or t
tcagtcgcactagtcacgaccggtgctcgatttagacgtctcatcaaggaaggaaggggcagcaagatggtgttgcagacccagtcttcatttctctgttgctctggatctctggtgcctacggggacatcgtgatgacccagtctccagactccctggctgtgtctcgtgggcgaggacgggccaccatccaactgacaacgtccagccaggagttgttttaaccacgtacggtaccaaacaataaagtaattactcgcttaggtaaccagacaacgaaaccaggacacgcctctaagttnctactatttacgnggcagtccgtacccgggtaggtcccggggtcctcgaccgtattcgaggccggcgaggccgggtctaggaacgacgacgttactttcaccttctaccactatacacgcctacgcccgtgcgacggcgtaggaagtagttggtacggtacttagtttacttacgtgtacagtactaacgttatttaagttacggttaacgttcctacgttacggttacgggttttaccggggacccggggtaacctaggtcgtagggtaacgacgtaaaccgaaacggtacgttaggtcggttaccacggtaccaccgtacgttccgttcgtttaccttcctacccgtttccccg

SEQ ID NO: 3607 - DNA, 582 bp, Homo sapiens
  misc_feature: GYAE6OF01CCYD9.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttacacaggtaccaacaaataagaattacttcgcttggtaccagcaagaaaccaggacagcctctaagttgctctatttacgtgggctagtccgtacccggggtaggtcccggggtccctcggaccgtacttcgaggcggcgaggtcgggtctaggacgacagtactttccactcctaccacctactcacgcacgcctggcaggctagaagagtgtaggacttagtttattacgtgtcagtactaagttattaagtagtacgttcctagtacgttacggtttcggggaccgggtacaggcgtaggagtactaacgaaacgtacgtggacgtctcgacctaccgtgttactacgtccttctccgttccc

SEQ ID NO: 3608 - DNA, 758 bp, Homo sapiens
  misc_feature: GYAE6OF01AP15Z.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggattctctggtgcctacggggacatcgtgatgacccagtctccagactccctggctgtgtctctgggcgagagggcccaaccatcaactgcaagtccagccagagttgttttaacacaggtaccaaacaaataagtaattacttcgcttaggtaaccagacaacgaaaccaggacacgtcctacctaaagtcgcttacaagtttacgtgggacaacgttccgtaacccggggacggttcccgggggtccctacggaacccgtattccgaacggtcgggcaacggcgggtctaggaacgtaacaggtaactttccgaaactcccgtacctaaaccgtaacttaccgaacggtaccgaacggtcccgttaggacccgtaaagggtccgttaaggtaaacggtagttacgggtacgggtaaccgtttaaggttttaacgtttaaccgttacgttacgtaaagtaccgttaaagtttaacgtttaagttaacggttaacgttccgttaacgtaacggttacgttttacggggaccccggggtaacaacggtcgtacgggagtaaacctaacgtaaaaccggtacgtaggtacggtccttacgaacctaaccgtacgtttaccggtacgtttacccttacgtacccgtttaccccg

SEQ ID NO: 3609 - DNA, 627 bp, Homo sapiens
  misc_feature: GYAE6OF01B17OO.39.31.C09.1.454.CMB.1.raw
  modified_base (315)..(315): a, c, t, g, unknown or other
  misc_feature (315)..(315): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgagacggcccacatcaactgacaagtccagccgagtagttgtttacacgtaggtaccaaataataagtaattacttcgcttaggacccagacaaagaaaccaggaacacgcctactaagttcgctactaatttacgnggactagtccgtaacccgggtgtcccgggtccaggacccgtagttcgacggcgacgcggtcggtcagacgatagtacttcacttcncactncacncacgctagacgngactagaagtgtgtaggtacttagtttacgtacttgtaccgtagtcgtaagttaagtacgttaagtccgtacttacggtacggttacggttaccgggacgggtaccaggtaccggtagggtaaactacgtaaaccgaaacggtacgttggtacggttcaccgtaacgacctaacgtttcacggtttcctttcgcctttacccccg

SEQ ID NO: 3610 - DNA, 698 bp, Homo sapiens
  misc_feature: GYAE6OF01A7ZJP.39.31.C09.1.454.CMB.1.raw
  modified_base (624)..(624): a, c, t, g, unknown or other
  misc_feature (624)..(624): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtcctccagacctccctggctgtgtctctgggcgaggacgggccaccatcaactgcagtccagccagagtgttttacacacggtccaacaataagaatttacttcgtcttaggtacccagacgaacgaaaacccgaggaaccacgtcccttaccttaaagttcgcctctatttacgtgggcctacgttcccgtaaccccggggtaccggtccccgggggttacccctacggtaccccggtattaccacgggccgggtaccgacgggccggggttcctaggaacgaccgtaagtaacttttccacttccgtccctacccacttacaacggcaccggtacccgtgacccgaacgggtccgtaaggtaagtaacgttgggtacggtacgtttaaggttttacttaacgttgtacagtacttagttaagttaacgttgtacctttcgtacgtagttcgggtttacgggcccggggtaactaaggngtaggactagtaaccgtaacgtacgttggtacgcgtacgaccaccttacgtcttcttccttcctacgttccccg

SEQ ID NO: 3611 - DNA, 765 bp, Homo sapiens
  misc_feature: GYAE6OF01D87Q1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctcccgtggctgtgtctcgtgggcgagacggcccacataccaactgacctaacgtccacgaccagtagttacgtttacacgacggtaccaaacgtaaataagtaatttacgttcgtacgttacggtaccacgacgaacgaaaccgacggaacacgtcccgtaccttaagttcgcttacctacgtttacgtggtactacgtacccggtaacccgggtaccggttaccccggggtcctaccgtaccgtacgttccggacggccgggtacgagggtccggtacgtacggaacgtacgtaacgttcttaccctacgtccctaccgtacctacgtacgacgaccgaccgtccgtaacgacggtacggtcgttaaggaaagttacgggtaccgtaggttaaccgtttagttttacgttaacccggttgtacggtaacgtaacgttacggttaagtttagttaacgttaaccggtcctttaacggtaccggtttacgggtttacccggggacggtaaacccggtagtaaccggtacggagtaccgtaaacggaacgttaacggtggaacgtcgaccgtcctaacgtcccttagtaccttacttccgtacccgtccc

SEQ ID NO: 3612 - DNA, 655 bp, Homo sapiens
  misc_feature: GYAE6OF01E20HC.39.31.C09.1.454.CMB.1.raw
  modified_base (311)..(311): a, c, t, g, unknown or other
  misc_feature (311)..(311): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttacacgacggtaccaaacaaataagtaactttacttcgctttggtaccagacgaacgaaaccgaggacacgcctactaagttgctactatttacgngggcagtccgtacccgggtcgtcccggggtcctacgtaccgtattcgacgccggcacggcggtacgtgagacgagtactttccactcctacaccctactacgaccgacgacggtcccgtacgaccgtacggacgtacggaagtagttcggtacggtacgttaacgttttacttacgtgttacgacgtctaagtttattaagttacgtacgttaccgtacgtacggttaccgtttacggggacccgggtaacgagtcgtaggaacgtacaacgtaaaccggtacgtaggtacggtcgtacgacgtaacctacgttaccttagttcccttacgtcctttaccccgg

SEQ ID NO: 3613 - DNA, 689 bp, Homo sapiens
  misc_feature: GYAE6OF01BWLFM.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggactatcgtgatgacccagtctccagactccctggctgtgtctcgtgggcgaggagggccaccatacaactgacaagtccagccagtagttgtttacagtacggtaccaaactaaataaagtaacttacttcgtcgttaggtaaccagacaaggaaaccaggacagtacctactaagttgactctaatttacgtggacacgtcccggtaccggggacgtcccggggtacctggacccgtattacgacggccggacgtaggccggtatggaacgactagtactttacaaccgttcacaaccatacgacggaccacgaccctgaccgtaggacctaggaaagtagtggacggtacgtaagtttataccgtagtacgtagtacgagttaagtaataacggttacgtacccttagtaaggttaccggttttacggggacccggggtaacgaacggtacggtagggtaaacgtaactaaaccggtaaaacggtaaccgttagggacggttccgtaacggtaccgaacttacggttacgttaccggttaccttcgtccttaacccccg

SEQ ID NO: 3614 - DNA, 608 bp, Homo sapiens
  misc_feature: GYAE6OF01DXHGW.39.31.C09.1.454.CMB.1.raw
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
tcagtcgcactagtcacgaccggtgctcgattttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagaggccacatcaactgcaagtccagccagagttgttttacacacggtaccaacaataagaacttacttcgtacttacggtaccagacaacgaaaccaggacacgcctctaagtcnctcatttacnggcacgtcgtaccgggagtcccggggtcctcgaccgtattcgacgcggacaggccgggtntggacgacagtatttcactcacaccgtatacacgcacgctgcacgggctagaacgngttcggngtactagttttactaacgttgtacgatacgtaattaagtttactaggttacgtcctacgtacggttacggtttccggggacccgggtaacaggtactagggactaacgtaccgtaaaacggtccgtagggtccggtatcggaacctaccgtattacgtccgtttacttcgtacgttcccccgg

SEQ ID NO: 3615 - DNA, 678 bp, Homo sapiens
  misc_feature: GYAE6OF01D151Z.39.31.C09.1.454.CMB.1.raw
  modified_base (439)..(439): a, c, t, g, unknown or other
  misc_feature (439)..(439): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgcaacgtccacgccagtagttgtttaacactacggtaccaaacaataaagtaattacttcgtcttaggtaccagacaagaaaacccaggaaccacgtaccctactaagttgcttctatttactggctagtccgtacccggggacggtccccggggtcctgaccgattacgaggcggcacggtcgggtctaggacgacagtactttccacgtcctaccaccatacgacgtcacgccgtgaccgnggtactaggaagtagttcggtcgtaacgttagttttacttacgttgtaccgagtaccgtatttaacgttacgttaagtacccgttcttaccgtacggtttaccgggtttccggggtacccggggaacctacggtacggttaggaacgtacgttaacccggtaaaaccggtaacggttggtacgggtcctaccggtaccacctacgttcgttacgttacttcccgtactttaccccccgg

SEQ ID NO: 3616 - DNA, 551 bp, Homo sapiens
  misc_feature: GYAE6OF01A10HX.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaaataagaattacttcgcttggtaccagcagaaaccaggacagcctcctaagttgctctatttacngggcatccgtacccgggagtccggggtcctgaccgattcagcggcacggcgggtctgagacagtatttcactctacacctatcagcacgcctgcaggctaggaagtatgtggtcttaagtttacttacgtgtacaggtctaagttacttagtacgttacgtcctagtacgttacggttcgggaccgggtacgagtcgtaggagtactaacgaaacgtcgtgcggcacgacctactacttcgtatccttctcttcccg

SEQ ID NO: 3617 - DNA, 810 bp, Homo sapiens
  misc_feature: GYAE6OF01DKJPV.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctcgtggtgccgtacggggacatcgtgatcgacccagtcctccagacctccctggctgtgtctcgtgggcgagacgggcccaccataccaactgacaacgtccagccagtagttacgtttacgaacgtacggtaccaaaataaataaagtaactttacgttcgtacgttaggtaccagacgaacgaaaccaggacacgtcctaccgttaagtcgtactacttaagtttacgcggtactaccgtaccgacccgggtacgtacccgggtcctacggaccgttacgtcgaacggtcggcgtacgggtccggtactacggaacgtaacacggttactttacccacgttacctacctaaaccacgtaccaacggtccgaaccgtccgtaccgggacgtacgggtaaccgtaagggtaaagttggtttacggggttaccgtaaccgttttaaacgggtttttaactacgtttaacggtaacccgtaggttaaccgtaaagtttttaagtttaacgttaaccggttaccgttaaccccgtttacggtaacgggtttttaaccgggtttcccggggggaaaccgggttaaccaaccgggttgtaaacgggaacttaaaccgtaaaacggtaaaccggtgttacgggaacgtacgtccggtaaccaccgtttacgttccgttagtttccctacgtacccgtttccccgg

SEQ ID NO: 3618 - DNA, 603 bp, Homo sapiens
  misc_feature: GYAE6OF01CF5EC.39.31.C09.1.454.CMB.1.raw
  modified_base (307)..(307): a, c, t, g, unknown or other
  misc_feature (307)..(307): n is a, c, g, or t
  modified_base (370)..(370): a, c, t, g, unknown or other
  misc_feature (370)..(370): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagacgggccaccatcaactgacaagtccagccagtagttgttttacacaggtaccaacaataagaattacttcgtcttaggtaccagacaagaaaccaggacacgcctactaagttgcttacactttacgngggacatccgtacccggggtcggtcccggggtccctaggaccgtatcgagcgcgaggcggtcngagacagtatttcactctcaccactcacgcacgtcctcgacgacggtacgtaggaaggtagtggtacggtacgttaagtttacttaacgtgtacgacgtctagttattaagtagtacgtccgtcgtaggtttaccggtttcgggacccggggtacgagtcgtaggacgtactaacgaaacgtacgtggtacgtcgtaccgactacctacttctacgttcttccgtcttccccg

SEQ ID NO: 3619 - DNA, 752 bp, Homo sapiens
  misc_feature: GYAE6OF01C5IU3.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtcctccagacctccctggctgtgtctcgtgggcggagacgggccaccatcaactgacaacgtccagccgaagtagttacgttttacacgtacgtaccaaacaaataaagtaactttacgttcgcgttacggtaccgagacaaacgaaaccgacggacacgtacctaccttaacgttcgtactcttacgtttacgtcgggactacgtccggtacccgggtacggtcccgggtcctcgtaccgtatcgacggcggcgacggccggtctacggacgaacgtacgtactttccacttcctaccgacctacgtacgacggccaacgtccgtacggaccgtacgggtactacggaagtaggttacggtaggtacgtttacgttttacgttaccgttaggtaccgtagtacgttaagttaacgtttaggtaacgttacgttacccgttacggttacggttaccgggtttaccggggaacccggggtaaccgtaacggtacggttaacggtaaacggtaaccgtaacggtaaaccggttacggttggtaccggtaccgtaccgtaaccgtaaccgttacgttaccgttactttaccttccgttaccgttaccccg

SEQ ID NO: 3620 - DNA, 615 bp, Homo sapiens
  misc_feature: GYAE6OF01CDPKD.39.31.C09.1.454.CMB.1.raw
  modified_base (295)..(295): a, c, t, g, unknown or other
  misc_feature (295)..(295): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgtttacacaggtaccaacaataagaattacttcgcttggtaccagcagaaaccaggacagcctcctaagttcgctcatttacnggcatccgtacccgggacgtcccggggtccctgaccgtattcaggcgcaggccggtctgagacagtatttcactctcaccatcagcacgtcctgacgaggcctagaagagtcgtgacttagtttactacgtgtacgagactaagttattaagtacgttacgttacccgtcgtaacgtttaccggtttacggggaccccgggggtaacctaacgggtccgtagggaacgtacgttaaaccggaaaacgtaaccgttggtacgggacgttccggaacctaaccgtacttaccgttcggtttaccttacctcgtttacccccg

SEQ ID NO: 3621 - DNA, 697 bp, Homo sapiens
  misc_feature: GYAE6OF01BWRPI.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgagacgggccaccatcaactgacaagtccagccagtagttgttttaaccacgtacggtaccaaacaaataaagtaattacttcgacgttacgtaccagacaagaaaccgaggacacgcctactaagtgctactatttacgtggctaacgtccgtacccgggacggttccccggggtaccctacggtaaccgacgttacgacggtcggactacggtcggtctaggaacgactaagttactttacaccttacctaccgtaacctacgtacgaacgtaccacgtacccgtagccgaaggtacctaagggaaacgtagttaggtacggtaccgtttaaagttttactacgtacggtacacgtaacttaagttaacttacggttaacgtaccgttacctacggtaacgtttccgggtttaccggggaccggggtaacctaggtcgtaacggagtaaccaaacgtaacggtacgtggtaggcctagaccctactacgtacgttacgtcttacgtcccttaccccg

SEQ ID NO: 3622 - DNA, 580 bp, Homo sapiens
  misc_feature: GYAE6OF01BB66D.39.31.C09.1.454.CMB.1.raw
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacacgcctcctaagttgctctatttacgngggcatccgtacccggggagtcccggggtccctgaccgattcgagcggcgaggcgggtctggagacagtactttcactcctcacctatcagcacgcctcgcgaggctagaagtagtggtaggtcttaagtttattacgttcgtcagtacgtagttatttagtagttacgttacctacgtacgttacggttttacggggacccggggtacgacggtcgtaggagtataccgaaacgtacgtggtacggtctacgccactactcttagttccttcgtacttccccg

SEQ ID NO: 3623 - DNA, 621 bp, Homo sapiens
  misc_feature: GYAE6OF01AXJBE.39.31.C09.1.454.CMB.1.raw
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (335)..(335): a, c, t, g, unknown or other
  misc_feature (335)..(335): n is a, c, g, or t
  modified_base (609)..(609): a, c, t, g, unknown or other
  misc_feature (609)..(609): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagtgttttacacaggtaccaaacaataagaatttacttcgcttggtaccagcaagaaaccaggacagcctcctaagttgctcatttacgngggcntcgtacccgggagtcccgggtccctgaccgtnttcgacgcggcaggcggtctgacgacagtattcactctaccacatcagcacgcctgcgaggctaggagtagtggtacggacttagtttacttaacgttgtactacggtctaaggttaactttaagttaacggttacgttacccttacgtacggtttaaccggtttcggggaccccgggggtaacctaaggtaccggtagggtaacgtaactaacgaaaaccgtacgttacggtcggtacgtcggactacctacgttcgttacgttcctttaccncgtttacccccg

SEQ ID NO: 3624 - DNA, 541 bp, Homo sapiens
  misc_feature: GYAE6OF01B0Q8V.39.31.C09.1.454.CMB.1.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (329)..(329): a, c, t, g, unknown or other
  misc_feature (329)..(329): n is a, c, g, or t
  modified_base (355)..(355): a, c, t, g, unknown or other
  misc_feature (355)..(355): n is a, c, g, or t
  modified_base (428)..(428): a, c, t, g, unknown or other
  misc_feature (428)..(428): n is a, c, g, or t
  modified_base (534)..(534): a, c, t, g, unknown or other
  misc_feature (534)..(534): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattactcgcttggtaccagcagaaaccaggacagcctcctaagttnctcatttacngggcatcgtacccgggagtccggggtccctcgaccgnttcgagcgcacggcggtctgacgacngtatttcactctcaccatcacgcagcctgcaggctgaacgatgtgctagtttatacgtgtcagtactaagttnttaatacgtacttcgtatacgtcgtttagggaccgggtacacggcttaggacgtaacgtaccaaacgtacgtggtacggtctgccaactactcttagtcttccgtnttccccg

SEQ ID NO: 3625 - DNA, 748 bp, Homo sapiens
  misc_feature: GYAE6OF01DI8AU.39.31.C09.1.454.CMB.1.raw
  modified_base (495)..(495): a, c, t, g, unknown or other
  misc_feature (495)..(495): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtgatcgacccagtcctaccagacctccctggctgtgtctcgtgggcgaggacggccaaccatacaacgtgacgaacgccacgccagtacgttgtttaacacgtacggtaccaaacaaataaacgtaatttaccgtcgtacgttacggaccacgacaaacgaaacgagacacgtccttaacgtaagttcgacttacgttaacgtttacggtcggtacctacggtacccgtacccggggtaccgggttcccgggtaccccgtacggaacccgtacgtcgaacggccggacggacgggtccggttatacggaaacgtacgtacgttactttccgaacctcctaacctaccgtactacggaacnccgtacgtcccgtaggacgacggtacgaaggtaagttaggttacggtacggaacgttttaaggttttacctaaggtcgtacgtaggaacttaagttttaacgtaacttacgttccgtaccttacggtaccggtttaccgggtaccgggtaccggggaactaggtacggtagaacgttaacaaccggtaaagtacggtggtaccgcgttaccgaaccttacgttacttaccgtgttacccgtctaccggtcccc

SEQ ID NO: 3626 - DNA, 697 bp, Homo sapiens
  misc_feature: GYAE6OF01DRQRL.39.31.C09.1.454.CMB.1.raw
  modified_base (161)..(161): a, c, t, g, unknown or other
  misc_feature (161)..(161): n is a, c, g, or t
  modified_base (174)..(174): a, c, t, g, unknown or other
  misc_feature (174)..(174): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctcccnggctgtgtctcgngggcgaggacggccaccatacactgcaacgtccagccagagttcgtttaacactacggtaccaaactaaataaacgtattacttcgtcgttacggtaccagacaacgaaaccaggacacgtcctacctagtcgctactactttacgcggactacgtccgaccgggtacggtccgggtccctacgacgacttcgagtcggacgacgggtcgggtctagacgactagtacttccacgtcctaccgtacgactaccgagccgtacgcccgtgaccggtaggtacgtaagtaagtacggttagggtcggtacttttaacgtttaacttacgtacggtacacgtaccgttaaagttttacttagtaccgtaccgttaccgtaacggtacgggtttacggttaccggggaccggggtaaccgaggtccggtagtaaccggtaaacgtaaccgtaaacggaccggttgggaccggttaccgccgtaccacgtttaccctcgtttacgtccttaacccgtcgttacccccg

SEQ ID NO: 3627 - DNA, 608 bp, Homo sapiens
  misc_feature: GYAE6OF01B269J.39.31.C09.1.454.CMB.1.raw
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacagcctcctaagttgctnatttacngggcatcgtacccgggagtccgggtcctgaccgtattcagcggcaggcggtctgagacagtatttcactctacaccatcacgtcacgtcctgacgacggtcgtaggaagtagtaggtcggtacttaagttttacttacgttacgtactaggtacctaagtttatttaacgttaagttacgtccttacgtaacgttaccggttttacgggacccggggtacctaacggtcgtagggaacgtacgtaaccgaaacggtaacgtaggtacggtacgtacgaccaccgtacgttcttacgttccttcctacgttaccccg

SEQ ID NO: 3628 - DNA, 728 bp, Homo sapiens
  misc_feature: GYAE6OF01CRBXY.39.31.C09.1.454.CMB.1.raw
  modified_base (189)..(189): a, c, t, g, unknown or other
  misc_feature (189)..(189): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
  modified_base (472)..(472): a, c, t, g, unknown or other
  misc_feature (472)..(472): n is a, c, g, or t
  modified_base (500)..(500): a, c, t, g, unknown or other
  misc_feature (500)..(500): n is a, c, g, or t
tcagtcgcactagtcacgaccggtgctcgatttagacgtctcatcaaggaaggaaggggcagcaagatggtgttgcagacccaggtcttcatttctctgttgctcgtggattctcgtgggtcgacccgtacggggacatcggtgatacgacccagttccaccaacgtcctcccgtggctgtcgtcgtgngggcgaggacgggccactataccaacgtgacaacgtaccagccgagtagtttagtttaccagacggaacctaaataataacggtaactttaccgtggtaccgttaggaaccagaaccgaaacggaaacgaggactacgccttacgttaatcgtctacttacggttacgcggaactccgtacccggggttaaccgggtcccggtcccgggtacaccggtacgttcaggccgcggacgcgggtacgtgacgngtaatacgttctaaccnctaccgataacctacngtaccgacgacgttcaacgcgtacggtnaagggtatggtacggttagttacgttaatttccgggactaggacctagtaacgttaaagtttacgtaacgttggaccctttacggtagggtttaccgttaccggggtccgggaacccggattagggaccgttaaacgaaacgttaaacgtaacccgtaaaggttccggtggaaccccttgtaaccccgccttacttacgttcggttccttaccaccgtttctacccgg

SEQ ID NO: 3629 - DNA, 676 bp, Homo sapiens
  misc_feature: GYAE6OF01BKX5K.39.31.C09.1.454.CMB.1.raw
  modified_base (378)..(378): a, c, t, g, unknown or other
  misc_feature (378)..(378): n is a, c, g, or t
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagtagtgttttacacacggtccaaacaataagtaattacttcgcttggtaccagcaagaaaccaggacagcctacctaagttcgctactatttacgtcgggctacgttccgtacccggggtaggtcccggggtccctacggtaccgtattcgacggcggcgacggcgggtntgacgactagtacttctacctcaccacactcacgcacgcctcgacgaggctaggtaagtgtggtcggtacttagtttacgtacttagtactagtacttaacgttatttaagtacgtacgttcccttacggtaacggttaccgggttttacggggacccgggggtaaccgacgggtacgtagggtaacgttaacgtaaaccggtaaaaccggtacggtttagggtacggtccgtacgtaacccgttaaccgttacgttccgtttaaccgttcctttaacccgttaccgtttaccccccg

SEQ ID NO: 3630 - DNA, 566 bp, Homo sapiens
  misc_feature: GYAE6OF01CCMJB.39.31.C09.1.454.CMB.1.raw
  modified_base (299)..(299): a, c, t, g, unknown or other
  misc_feature (299)..(299): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagagggccaccatcaactgcaagtccagccagagtgtttacacaggtaccaacaataagaattacttcgcttggtaccagacaacgaaaccaggacacgcctacctaagttgctctatttacgnggcatccgtacccgggaggttcccgggtccctgaccgattcaggcgcgaggccgggtctggacgacagtctttcactctcacntcngcagcngcagctagagatgtgtctagttactacgtgtcagtctagttattagtagttacgtcctacgtacgttacgttttacggggacccgggtaacgtacggtcgtaggaagtacgtaccgaaacggtacgtaggcggtccacgaccaccgtactcgttacgttccttcgtacttccccg

SEQ ID NO: 3631 - DNA, 578 bp, Homo sapiens
  misc_feature: GYAE6OF01AO02P.39.31.C09.1.454.CMB.1.raw
  modified_base (322)..(322): a, c, t, g, unknown or other
  misc_feature (322)..(322): n is a, c, g, or t
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgaggagggccaccatcaactgctaagtccagccagagttcgttttacacgaggtccaaacaaataagaattacttcgcttggtaccagcaagaaacccaggacacgcctcctaagtgctcatttacgtgggcatccgtacccggggngtcccggggtccctgaccgtattcgagcggtcgaggcgggtcngacgacagtactttcactctcaccctancacgcagccctgcgacgcacgagtacgtggtggtctagtttactctgtcgagntagtntaagtacgtctctacncgttacgtttcggggaaccggggtaccaggtcgtaggacgtacgtacgaaaccgtacgtgggtacgtccgtacgtacctaccgtacttctacgttcttccgcgttcccccg

SEQ ID NO: 3632 - DNA, 742 bp, Homo sapiens
  misc_feature: GYAE6OF01DX59M.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggacgggccaccatccaactgacaacgtccagaccagtagttagttttaacacgacggtaaccaaactaaataaacgtaactttacgttcgtcgttacggtaaccacgacaaacgaaaccgaggaacacgacccaaccttaagttcgccttactaagtttacggtcggactacgtcccggtaacccggggtacggttacccggggtccctacggaccgtacgttcggacggccgggacgtacgggtaccggggttcgtacgggtaacgaacgacggtttactttaccgaacccttaccgtacccaacctacgttacgaacggtaccacgttccgtacggacgaacgggtccgtaaggtaaacggtagttcgggtaggtacttaagttttactacgtgtcgacgtacgtaacttaatttacgtacgttcgtaccgtacgtacggttcggtttaccggggaccgggtaacgacgtacggtaggtaacgaactaaccgaaacggttacgtggtacggtcctcggtaacctaccgtcgttctaccgtttctccttaccgttaccccg

SEQ ID NO: 3633 - DNA, 575 bp, Homo sapiens
  misc_feature: GYAE6OF01AY4EJ.39.31.C09.1.454.CMB.1.raw
  modified_base (320)..(320): a, c, t, g, unknown or other
  misc_feature (320)..(320): n is a, c, g, or t
  modified_base (360)..(360): a, c, t, g, unknown or other
  misc_feature (360)..(360): n is a, c, g, or t
  modified_base (408)..(408): a, c, t, g, unknown or other
  misc_feature (408)..(408): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccctggctgtgtctcgtgggcgagagggccaccatcaactgcaagtccagccagtagttgttttaccacgaggtaccaaacaataagtaattacttcgcttggtaccagcagaaaccaggacacgcctcctaagtgctcatttacgtgggcatccgtacccgggnggtcccggggtccctgaccgattcagtggcaggcgggtcngagacagtactttcactctcaccatcagcagcctgcgaggctagaagntggtggtactagtttacttagtcgtcgatcctaagttattagtaagttctccctacgtagttaccgtttcggggacccgggtaacgagtcggtaggagtaactaccgtaaacggacgtggtcggtcgtacgccaccgtacttccgttacgttcttctccgttccccg

SEQ ID NO: 3634 - DNA, 649 bp, Homo sapiens
  misc_feature: GYAE6OF01DROIX.39.31.C09.1.454.CMB.1.raw
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccctggctgtgtctcgtgggcgagagggccaccatcaactgcaagtccagccagagtgttttacacaggtaccaaacaataagaattactcgcttgtaccagacagaaacagacagcctacctaagttgctactatttacngggcataccgtacccgggtagtcccggggtaccctgacccgtattcgacgcggcaggtcggtctgagacagatttcactctcacctatcagtacacgtccgtgacgacggtaccgtagtaaagagtaggtaggtaccgttaagtttttaacttaaccgttggtaacccgtaggtactaaacggtttaatttaagttaacgttaacgttacccgtaacgtacgttaccgttttacgggacccggggtaacctaacggccgtaggacgtactaaaccgtaaacggtaaccgtggttacggtccgtagtaacccgaacctacttaccggttagtttccttacctccgttacccccg

SEQ ID NO: 3635 - DNA, 758 bp, Homo sapiens
  misc_feature: GYAE6OF01DSV99.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctcgtggtcgccgtacgggactagtcgtgatcgaccctagtctccgagtacctcccgtggtctgtcgtcgtcgtgggcgaggacggccacatccgaacgtcgactaacgtccacgcctaggtacgttcgtttaccacgtacggtaccaaacgtaacgttaacgtaactttaccgttcggtaccgtttacggtaacccaaggtaccgaacggtaaaaccgacggtaaccaccggtacccttaaccgttaacgttcgtacctacgttaacgttaccgcggtacctaccgtaccggtacccggtacggtcccgggtacctagtaccgtacgtacgacggtaccggtcgtacggtccggtacaggtacgtacgtacgttacttccgaccttcgacctaaccgtcgtacgacgtaccgtcgaccgtagtaccgtaggtccgtaggaacgttagtacggtcgtactttaagttcgtacgcgtactacgtacttacgtaacttacgtacgtccgttaccgtacgtacggttacgttcccgggaacggtaacctaggacgttaagtaccgtaacgtaacgtaaccggtcgttacgggtctaccgtaccggtaactccggtattcccgttacgttaccgttaccgtccggttacccg

SEQ ID NO: 3636 - DNA, 692 bp, Homo sapiens
  misc_feature: GYAE6OF01BEKJ3.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgaggacgggccaccatcaactgacaagtccagccagtagttgtttacacaggtaccaacaataagaattacttcgcttaggtaccagacaagaaaccgaggacacgtcctacctaagttcgctactactttacgcgggactacgtccggtacccggggtacggtcccggggtacctacggaacccgtagttccgaggccggacacgggtccgggtctaggaacgtaacgtagttactttaccgaccttcctaccaacctactaccgaaggcctacgtcccgtacgaccgtacggtccgtaggtaacgtagtacggtagtacgtttacgtttacttacgttacgtacacggtacgtaagtttaatttaacgtagttaccgttaccttacgtaacggtttaccggttttacgggggacccgggtaactaacggtcggtacggaacgtaactaacgtaaacgtacgtggtacggtcgtaccgtactaacctgttacgttacgtttctccgtaccttccccg

SEQ ID NO: 3637 - DNA, 648 bp, Homo sapiens
  misc_feature: GYAE6OF01B5SEP.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttacacaggtccaacaataagaattacttcgcttggtaccagcaagaaaccaggacacgcctacctaagttgctctatttacgtgggcactccgtacccgggaggttcccggggtccctgacccgtattccgaggccggacgacggcggggtctggaacgactagtactttcactctaccacctatccgagccacgtccgtcgccgtaggcctaaggaacgtagtgggtacggtactttaaggttttacttaacgttcggtctaaggctaagtttactttaagtagttcgttacctacgtacgttacgggtttcgggacccggggtactaggtccgtaggtaacgtacgtaaccgtaaacggtacgttagggtacggtcctacgaccctaacgtacgttaccgttctttacccttccgtacctttaccccccgg

SEQ ID NO: 3638 - DNA, 794 bp, Homo sapiens
  misc_feature: GYAE6OF01EIV3Y.39.31.C09.1.454.CMB.1.raw
  modified_base (678)..(678): a, c, t, g, unknown or other
  misc_feature (678)..(678): n is a, c, g, or t
  modified_base (718)..(718): a, c, t, g, unknown or other
  misc_feature (718)..(718): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtcctccagacctcccgtggctgtgtctcgtgggcgagacggccacatcaactgacaacgtccagaccaaggtagttacgtttaacacgtacgtaccaaactaaataaagtaactttacgttcgtacgtttacggtaccaaggacaaacgaaaaccgacggaaccacgtacccttaccgttaacggttcgtaccttacgttaacgtttacgtgggacctacggttacccggtaccccgggggtacgggttccccggggttaccctacggtacccgtacgttacggacgggtccgggacgtacgggtccggggttactaggaaccgaactacggttacctttaccgtacccttcctaccaccgtactccgaacgtccaccggtcctacggaccgtaggaccgtaagaacgttcggttacggtaggtaactttaggttttaactcgtacgtacgtagtacgttaagtttattacgttaggttaccgttccgtaacggtttacggtttcccgggttaacggggaccccgggtaaacngggtacgtaacgggtaacttacgaaacccgttaaaccggnggtttacggcgttaccgtcggaaaccccttacgttacttaccggtttacgttccctttaaccgtccgttacccccg

SEQ ID NO: 3639 - DNA, 797 bp, Homo sapiens
  misc_feature: GYAE6OF01C2WXQ.39.31.C09.1.454.CMB.1.raw
  modified_base (244)..(244): a, c, t, g, unknown or other
  misc_feature (244)..(244): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgaccctagtcctccagacctccctggctgtcgtctcgtgggcgagacgggccacatacaactcgacaacgtccacgccagtagtagtttaccacgacgtaccaaanaaataacgtaactttacgttcgtcgttacggtaccaacgacgaaacggaaaacccgacggaaccaccgtaccctaccgttaaggtctaccttacgtacgtttacgtcggacctaccgtaccggtacccgggtaccgggtcccggtaccctcggaacccgtattccgacggccggacgacgggtccggtacgtaggaacgtaactacggttaacttcctacctactaccaccgacctaggaccaccgcgtacctcgacccgaggtttacctaagggaaaccggtgtttcccggagggttaaccttttaagtttaacgttcccggtagtacgtaacgttaatttaaggtttaaccttaagggttacgtttcccggtaaaccttcccggttaaaccggggtttttccggaaccgggggggacccggtaacctagggttacgggaaggttaacaaaacgggtttaaccgaaaccggttgggtccgttaaggcccgtttaacggaccctttaaacccgtcgggtttcccttacttccctttaacgccgtttacccccc

SEQ ID NO: 3640 - DNA, 648 bp, Homo sapiens
  misc_feature: GYAE6OF01EX1M0.39.31.C09.1.454.CMB.1.raw
  modified_base (239)..(239): a, c, t, g, unknown or other
  misc_feature (239)..(239): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (488)..(488): a, c, t, g, unknown or other
  misc_feature (488)..(488): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagtaacnttacttcgctcgtaccgacgacaacgaaccgccgacgacgtacctaccgtaacgttagtaccnttacctacgnttaacttacgggtacccggtacgtccggttaccccgggtacggtacccggggtacccgtccggaccggtacgtaccgacggccggtcgacggacggtacgtacggtacgtacgacgtacttactacctactacctaccgacctacgaccgtacgaccgtacgtacgtacgacggtnaacgtacggtacggncngtttacgttacggtacgttacgttacgttacgtacgttacgtacgtacgtacgttacgttactagtacgtttcgtacggtacgtacgttcggtacgggacgtacgtacgacggaacgtacgtacgaacgtacgtgtacgtacg

SEQ ID NO: 3641 - DNA, 625 bp, Homo sapiens
  misc_feature: GYAE6OF01BAK44.39.31.C09.1.454.CMB.1.raw
  modified_base (296)..(296): a, c, t, g, unknown or other
  misc_feature (296)..(296): n is a, c, g, or t
  modified_base (415)..(415): a, c, t, g, unknown or other
  misc_feature (415)..(415): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaataagaattacttcgcttggtaccagcaagaaaccaggacagcctcctaagttgctctatttacngggcatccgtacccgggaggtcccggggtccctggaccgattcgaggccggcacggcgggtctggacgacagtacttttcactctaccacctatcagcacgcctgcgaggctagaagtntggtggtacttagtttacttacgtgtacgtagtcgtaagttaacttaagtacggttacgttaccctacgtaacggtttaccggttttaccggggacccgggggtaacctaagggtccgtagggaacgtacgtaaccgtaaaccggtacgttaggtacggtaccgtacgaccctaccgtacgttcttgttacccttcgtaccgttcccccg

SEQ ID NO: 3642 - DNA, 587 bp, Homo sapiens
  misc_feature: GYAE6OF01BF8HT.39.31.C09.1.454.CMB.1.raw
  modified_base (243)..(243): a, c, t, g, unknown or other
  misc_feature (243)..(243): n is a, c, g, or t
  modified_base (289)..(289): a, c, t, g, unknown or other
  misc_feature (289)..(289): n is a, c, g, or t
  modified_base (401)..(401): a, c, t, g, unknown or other
  misc_feature (401)..(401): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacagtccaacaataagaattacttcgnttggtaccagcagaaaccaggacagcctctaagtgctctatttacngggacagtccgtacccggggagtcccggggtccctgaccgtattcagcggcaggccgggtctggagacgagtatttcactctcaccatcacgcacgcctgcaggctagaagntggtggctagtttatctgtcagctagttattattagtacgtcctacgtacgttacggtttcgggccgggggtaacccaggtcgtagggaacgtactaaccgtaaacggtacgttaggtcgggtaccgtagtaacccgtaacccgtaacttcccgttagttaaccctttccgtaccgtttacccccg

SEQ ID NO: 3643 - DNA, 567 bp, Homo sapiens
  misc_feature: GYAE6OF01DOJG1.39.31.C09.1.454.CMB.1.raw
  modified_base (295)..(295): a, c, t, g, unknown or other
  misc_feature (295)..(295): n is a, c, g, or t
  modified_base (410)..(410): a, c, t, g, unknown or other
  misc_feature (410)..(410): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttacacaggtccaacaataagtaattacttcgcttggtaccagacagaaaccaggacagcctctaagttgctctaatttacgnggcagtccgtacccgggagtcccggggtccctcgaccgtattcgacgcggcgaggcggtctgagacagtatttcactctacacatcacgacacgcctgacgaggctaggaaacgngtggtggacttagttttactcgtcgtacgagacgtagttaattatagtacgtccttacgaacgttcggtttacgggaccgggtaacagcgtagagtactacgaaacgtacgtgtacggcttacggacctaaccgtattcgtattctctcgttccccg

SEQ ID NO: 3644 - DNA, 781 bp, Homo sapiens
  misc_feature: GYAE6OF01EJRHS.39.31.C09.1.454.CMB.1.raw
tcagtcgcactagtcacgaccggtgctcgatttagacgtctcatcaaggaaggaagggggcagcaagatggtgttgcagacccaggtcttcatttctctgttgctctggatctctggtgccgtacggggacatcgtgatcgaccctagtctccagtacctcccgtggctgtgtctcgtgggcgaggacggccacatcaactgacaagtccacgccagtagttcgtttaacacgtacggtaccaaactaaataacgtaactttacttccgtcgtttacggtaaccacgacgaaacgaaaaccgacggaaccacgtaccctaccgttaaggttcgaccttactaacgttttacggcggtactacgtacccgggtacccggggtaccgggtccccgggtaccgtacggtaacccgtacgttaccgacggaccggcgtacggtccggggtactacggaacgactacggttactttaccgtaccgttcctacctaacctacgtacgaccggtcgacgtccgtacgaccggtacgtacgtaggtaacgtggttacgggtacgtcgttttaacggttttactacgttacggtaccgaagttacgtaagtttaacttaagttacggtacgttacccggttagttacccgggtttacgggtttaccgggggacccgggtaacgtacggtcggaaggtacgaacggttaaaccgaacggttacgtacgggtacgtaccggtacgtaccctacttcggttacttccgtttactaccgttcccgttaccccgg

SEQ ID NO: 3645 - DNA, 868 bp, Homo sapiens
  misc_feature: GYAE6OF01DD0ZI.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccgtggctgtgtctcgtgggcgaggacggccaccatacaactgacaacgtccagccaggtagttgtttaacacgtacggtaccaaactaaagtaaagtaattacttcgtcgttaggtaaccagacgaaacgaaaaccgaaggaaccgacgtacccttaaccgttaaacgttcgtaccttacgttaacgttttaacgtcgggactaacgttacccggtaaccccggggtaccgggttccccggggttaccctacggaacccggtacttacggacggaccggtacgacgggtccgggttacgtacggaacgtaacgtaacgttactttacctaaccgttcctaacccgtaaccgtacgtaaccgaacggacctaccgggtacccgtacggtaccggaacgggttacgtaagggaaaacgttaggttcgggttacgggttaaccttttaaacgggtttttaacctttacggttaacgttaccgtaacggttaacgtttaaacggttttaacttttaaagttaacggtttaaccggttcccgtttaaacggttaccggggtttaacccggttttaccggggggaaccccggggttaacacgggttaggaacgggtaaacgtaaccgtaaacgtaaaacggtacgtgggtacggtactaccgtaacccgcgttaacgttacccgtttgtttaaccctccgttacccgttacccccg

SEQ ID NO: 3646 - DNA, 591 bp, Homo sapiens
  misc_feature: GYAE6OF01EHB01.39.31.C09.1.454.CMB.1.raw
  modified_base (412)..(412): a, c, t, g, unknown or other
  misc_feature (412)..(412): n is a, c, g, or t
  modified_base (581)..(581): a, c, t, g, unknown or other
  misc_feature (581)..(581): n is a, c, g, or t
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgttttacacaggtaccaaacaataagtaattacttcgcttggtaccagcaagaaaccaggacagcctacctaagttgctctatttactgggctatccgtacccgggcgtcccggggtccctgaccgattcgagcggcaggcgggtctggagacagtactttcactctcaccatcagcacgcctgcgaggtctagaagtntgtcgtgtagtttacttacgttgtcgagtactagttattagtaggttacgtcctagtacgttacggttttcggggacccggggtaaccgtaagtcggttaggaacgtagtaaccgtaaacggtacgttggtacggtctacgacctaccgtattccgtagttacctttcnccgttccccg

SEQ ID NO: 3647 - DNA, 768 bp, Homo sapiens
  misc_feature: GYAE6OF01CNKM1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctggctgtgtctcgtgggcgagagggccaccatcaactgacaagtccagccagtagttgttttacacaggtaccaaacaaataaagtaattacttcgtcttacggtaccagacaagaaaccaggacacgcctacctaagttgctctatttacgtcggactactaccggtacccggggacgttccccggggtcctacgaccgtagtccgacggtccggccgaggtccgggtcgtaggaacgaccgtaagttactttaccctaccttccgtaccaaaccctacgtaccgacggaccgacgtcccgtaaggccggtacggtacggtaacggtaaagtacggttcgggttacggtaacgttttaacgtttttaacgtacgttacggtactaacggttacgttaaagttttagtttaaaccgtttaggttaaccccgtttaccttacggttaacggttttacccgggtttaccggggaaccccgggggtaactacgggtaccgttagggaacgtaacccggttaaaccgtaaaccgggttaacgttggggttaccggcgttacccgacctaacccttcgtttacgtcccgttttacttcctccgttaaccccccg

SEQ ID NO: 3648 - DNA, 717 bp, Homo sapiens
  misc_feature: GYAE6OF01C2KNQ.39.31.C09.1.454.CMB.1.raw
  modified_base (246)..(246): a, c, t, g, unknown or other
  misc_feature (246)..(246): n is a, c, g, or t
  modified_base (331)..(331): a, c, t, g, unknown or other
  misc_feature (331)..(331): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtgccgtacggggacatcgtgatgacccagtctccagtacctcctggctgtgtctcgtgggcgaggacgggccacatccaactgacaacgccacgaccagtagttcgtttaacaacgacggtaaccaaanaaataaagtaattacgtcgtacttacggaaccagacaaagaaaccaggaacacgtcctaccgtaagttctctactaagtttacgnggtatactccggtaaccccggggtacggtcccggggtcctacgaccgttactcgacggacgcgacggcggttctaggaacgtaacgacgttacttttaccaaccttcctaccgaccctagttaccaacggtacaccggcctggaccgaagggtactaacggaaaggtcgtttaccggtaagggtaactttaacgttttaactacgggtctaccggaagtactttaaggttaaattggtaacggtttccgaccttacggaacgggtttacccgggttgggggaacccggaaacgttacggacgttaagggaacctaaaggttaaaacccaaaggtacggtgtaggtcccaggtacaacgttccgtactgtacctctccgttaccccg

SEQ ID NO: 3649 - DNA, 807 bp, Homo sapiens
  misc_feature: GYAE6OF01B29ON.39.31.C09.1.454.CMB.1.raw
  modified_base (246)..(246): a, c, t, g, unknown or other
  misc_feature (246)..(246): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgaggacgggccaccatacaactgacaacgtccacgccagtagttagtttaacacgtaggtaccaaaanaataaagtaacttaccttcgtacgttagtaccagacaaacgaaaccaggaccacgtacctaccgttaaggttcgtactacgtaactttacgtcgggactacgtaccggtacccgggtacgggtccccgggtcctacggtaaccgtacgttaccggaggaccgggtacacggttccggtttacgagaacggaactagttacttttaccgacttacctacctaaccacgtcaacgcgaacgtccgtacggacgaacggtacgtaaggaacgtagttacgggtacgtaaacgttttacgttttaactaacggttcgtaccgtaaggttaccttaagttaagtttaacggttaaccgttacgttaccctttaaggaccgggtttttaacggggtttaaccgggggaccccgggggtaaaacttacggggtaccgaaaggggttaaacccgtaaaccgttaaaccggtaaaaaccggtacggttacggggtacgtttaaccggaccgtaaccccctaacgtttacttcgttacccgtttaccttccggtaccccttttacccccgg

SEQ ID NO: 3650 - DNA, 790 bp, Homo sapiens
  misc_feature: GYAE6OF01ECKR2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagtaattacttacgcttcggtaccagacaacggaaaccaggacacgtcctacctaagttcgctctactttacgtgggactagtaccgtacccggggacgtcccggggtcccttacggaccgtagttccgaaggtccggctacgggccggggttctaggagtaccgagtaactttcccgaacttcctaccaaccgtacgttaccgaacgtccgtaaccggtcccgtacggtacccgacggggtaccttaggtaaacggtaacggttacgggttacgggtaaccgtttaaaggttttaaccgttttaccgttacggtaaccgtaacgggttaaccgtaaagttttaacggtttaagtttaaacggttaccgttaacccgttaccggtaacggtttaccgggtttttaccggggaccccgggggtaaccgtaaccggtcggttaaacggggacgttaaaccgtaaccggtaaaaccggtaacgtttgggtaccgggtaccgtacggacccctaaaccggttacttacttacccggtttaccttccgaccgttttacccccg

SEQ ID NO: 3651 - DNA, 624 bp, Homo sapiens
  misc_feature: GYAE6OF01DVNC1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggcccaccatcaactgacaacgtccagccagtagttcgttttacacacggtaccaaacaataagaattacttcgtcttggtacccagcaagaaaccaggacagcctactaagttcgctctatttacgtgggctacgttaccgtacccggggtacggtccccgggggttccctacggtacccgtattccgacggccgggcgacggtccggggtctaggacgacgagtactttccactcctacaccatcgacgcacgcctagcgagctagagtagtggtgtacgttagtttacttacgttcgtacacgacttagttaactttagtacgtaccgttcctacgtagggtttccgtttacggggacccgggtaacacggtgtacggatacgtaacgaaccgtacgtggtagctacgactacgtactcgttattccttactccttaccccg

SEQ ID NO: 3652 - DNA, 585 bp, Homo sapiens
  misc_feature: GYAE6OF01DXHJA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaataagaattactcgcttggtaccagcagaaaccaggacagcctactaagttgctcatttacgtgggcatccgtacccggggagtcccggggtccctagaccgattccgaggtcggcaggccggggtctggaagacagtatttcactctcaccatcagcagcctgcgaggcgtagaagagtgtgctagtttattactgtcagctagttattagtagtacgtcctacgtagttacgttttcgggaccggggtaaccaacggtccgtagggaacgtacgtaacgtaaaacgtaacgttggtacggtcgtacgtacccaaccgtacttccgttagttccttacgtacgtttacccccg

SEQ ID NO: 3653 - DNA, 592 bp, Homo sapiens
  misc_feature: GYAE6OF01EPFH2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaataagaatttacttcgcttggtaccagcaagaaacccaggaacacgcctaccttaaagttcgctactatttacgtgggcattccgtaccgggtagtcccggggtcctgaccgattcagcggcacggcggtctgagactagtactttcactctacacatcagcagtcctgcaggactgaagtgtgtggtacttaagtttacttacgtgtctacgtactagtttaattagtaggttacgtcctacgtagttaccggttttcgggaccggggtaacaggtcgtaggaagtacgtaaccgaaacgtacgttaggtacggtcctagtaccaaccgtacttacgttacgtctttacgtcgttccccg

SEQ ID NO: 3654 - DNA, 686 bp, Homo sapiens
  misc_feature: GYAE6OF01D5UTL.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatgacccagtctccagactcccgtggctgtgtctcgtgggcgagacggccaccatcaactgacaacgtccagccagtagttgttttacacgacggtaccaaacaaataagtaattacttcgtcttacggtaccagacaacgaaaccacggacacgcctacgtaagtgctactactttacgtggactacgtccgtaccgggtacggtcccgggtcctcgaccgtattcgacggccggcgacggcgggtctaggacgactacgttactttccgaccttccaccaacctacgtaccaacggccgaacgtccgtcggaccgtacgggtacgtaaggaaacggtacggttggtacggtactttaagttttacttacgtcgttacgagttacgtaagtttaagtttagttacgttacgttccgtacggttacggtttacgggtttcggggaacccggggtaactacgggtacgtacggaagtaaccgtaaccgtaaacggtacggtggtacggcgtaccgaccacgttacttcgttacttctacctccgttaccccg

SEQ ID NO: 3655 - DNA, 627 bp, Homo sapiens
  misc_feature: GYAE6OF01EU7CH.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagttgttttacacaggtccaaacaataagaattacttcgcttggtaccagacaagaaaccaggacagcctcctaagttgctctatttacgtgggctatccgtacccggggacggttcccggggtccctgaccgtattcgaggccggcaggcgggtctgagacgagtatttcactctcaccatcagcacgcctgccgaggtctagaagtgttggtggtcttaagttttacttacgtgtacagtactagttatttaatacgttacgttcccttagtaacggttacggttttacgggggacccgggggtaacctaagggtccgtagggaacaacgttaaccggaaaacggttaccgttgggtacggtaccgttacggaccaaccctacgttcgtttacgttcccttcgtacctttcccccgg

SEQ ID NO: 3656 - DNA, 706 bp, Homo sapiens
  misc_feature: GYAE6OF01CQC4W.39.31.C09.1.454.CMB.1.raw
  modified_base (147)..(147): a, c, t, g, unknown or other
  misc_feature (147)..(147): n is a, c, g, or t
  modified_base (301)..(301): a, c, t, g, unknown or other
  misc_feature (301)..(301): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtcnccagacctccctggctgtgctctgggcgagagggccaccatcaactgcaagtccagccagagttgtttaacacaggtaccaaacaaataagaattactcgcttggaccagacaagaaaccaggacagcctactaagttcgactcaattttacgnggctagtaccgtacccgggagttcccggggtccctggaacccgtattaccgacggcggaccgtaggtccggggtatggaaaggacctaaggtaacttttacgaccctgttacccaacccaagttccgaaaggcaaccgtccgttacgacgacgggaccgtagaaaggtacgttaggtacgggaaccgtttaagttttaactttaaccggttcgttaaccgtaggtaacctaagttaatttaagttaagttaaccgttcctaacgtaaccggttacggttttacggggacccgggggtaacccgtaaggcggtaacgggtaactaagtaaaccgaaaacggtaaaccgttggtaacggtcgtaacgaccaaccgtacgttcttacgttcttaccgtacttaccccg

SEQ ID NO: 3657 - DNA, 717 bp, Homo sapiens
  misc_feature: GYAE6OF01CBTYI.39.31.C09.1.454.CMB.1.raw
  modified_base (313)..(313): a, c, t, g, unknown or other
  misc_feature (313)..(313): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttgttttacactacggtaccaaacaataaagaatttacttcgcttggtaccagacaagaaaaccaggaacacggtccctaccttaagtgcctacatttacgnggcatccgtacccgggacgtccgggtccctgaccgtattcgagcggcgacggtcggtactggaacgtacaagtactttacaccgtctaccgaccaacttacacgtaccaacggtccctaggtaccgtacgggtcctaagggaaacggtagttacgggtcggtaaccttaggtttttaacttacccgtgttaaccgaagtacgtaaacgtttaagtttacgtaacggtttaccgtttacccttacggtaacggtttaccggtttcggggaacccccgggggtaacacgggtacgttagggaacgtacgtaaccgaaaacggttaccgttacgggtacggtacccgttacacccgttaacccgtacgtttaccgttacgttacccttacgtacccgtttacccccg

SEQ ID NO: 3658 - DNA, 715 bp, Homo sapiens
  misc_feature: GYAE6OF01DIUAA.39.31.C09.1.454.CMB.1.raw
  modified_base (225)..(225): a, c, t, g, unknown or other
  misc_feature (225)..(225): n is a, c, g, or t
  modified_base (307)..(307): a, c, t, g, unknown or other
  misc_feature (307)..(307): n is a, c, g, or t
  modified_base (363)..(363): a, c, t, g, unknown or other
  misc_feature (363)..(363): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacgggccacatcaactgacaagtccagccagtagttgttttaccaanacggtaccaacaataacgtaattactcgtacttggtaccagacaagaaaccaggacacgcctactaagtcacctatttacgnggcatccgtaccggcgtccgggtcctacgacgtatacgagccggacgacgcggtcnggaacgactagtactttcacttcctaccgaacctataccaggccacgtccgtgacgacgcgttaacggaagtagttcggtacggtacgttaaagtttaacgtttaccgttcgttaacgaacgtacgtaagtttaatttaacgttaaggtttaccgtttacccgttacgtaaccggtttagggttttccgggggaaccggggtaacctaacgggtcggtaacgggtaaggtaaaccgtaacggtaaaaccggtaacggtttacgggtacggtacgttaccgtaacccgtaaccgttaaccgtttccgtttaccgttacccgttacctttaaccgttccccgtttaacccccgg

SEQ ID NO: 3659 - DNA, 653 bp, Homo sapiens
  misc_feature: GYAE6OF01DOMUJ.39.31.C09.1.454.CMB.1.raw
  modified_base (226)..(226): a, c, t, g, unknown or other
  misc_feature (226)..(226): n is a, c, g, or t
  modified_base (317)..(317): a, c, t, g, unknown or other
  misc_feature (317)..(317): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggacgggccaccatcaactgcaagtccagccagagttccccgtttanacaggtaccaaacaaataagtaattacttcgcgttaggtaaccagcaagaaaccaggacagccctacctaagttcgcccctagttttacgngggtacacgtccgtacccggggacggttcccggggtccctaggaccgtagttcgagggccggcaggccgggtctaggacgacgagtactttcacttctcaccatcagcacgcctgctaggctagaagtagtggtgacgttaagtttacttacgttcgtacgtagacgttaagtttagtttaattacgttacgttaccgtacgtaacggtttaccggttttcgggggacccgggggttaacaacgggtcgttagggaacgtaactaaccgaaacgtacggtggtacggtctcggacctacctagttccttacgttacttctccgttcccgtaccccg

SEQ ID NO: 3660 - DNA, 659 bp, Homo sapiens
  misc_feature: GYAE6OF01B7ZW3.39.31.C09.1.454.CMB.1.raw
  modified_base (626)..(626): a, c, t, g, unknown or other
  misc_feature (626)..(626): n is a, c, g, or t
  modified_base (650)..(650): a, c, t, g, unknown or other
  misc_feature (650)..(650): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtgccgtacggggacatcgtgatcgacccagtcctccagacctcccgtggcctgtcgtcctcgtgggccgaggacgggcccaccataccaactgacaacgtccagccagtagttcgtttaacacgtacggtaccaaacaaataacgtaacttacgtcgtcgttacgtaccagacaacgaaccaggacacgtcctaccgtaagtcgactactatttacgcggctacgtaccggtaacccgggtacggtcccggggtaccctaggaaccgtacgttcggacggcggaccgcggtccggtcgaaggaagacgtaacgttactttaccgaccttcctacaacctacgtaccgaaacggcctacggacccttggaccgtacggtgtaagtaaaggtcgtggtaacggtacttaaggtttactacgtgaactagtaactaggttacttaagtacgtactaccgtagtaccggttagttacgggaccggactagcgtaggactacgtaacaacgtgngacgcacaccactgtccttgcctntacctcccg

SEQ ID NO: 3661 - DNA, 748 bp, Homo sapiens
  misc_feature: GYAE6OF01BIL9H.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagaattacttcgcttggaccagcagaaccaggacagcctcctaagttcgctactatttacgtggacacgtaccgtacccggggaggttcccggggtacccttacggacccggtaatttccgacggtccgggacacgggtccgggtctaggaacgacgacgttacgtttccaccgtcctacaccctatccgagtaccgacgtcccgtggaccgacggggtaccgtaggaaaccggtagttacgggtacgggttaacgttaacggtttttaactttacggttcggttacctaacggtaccgtaagtttaactttaacgttaaggttacgtttacccgttacgttaacgggtaaccggtttttaccgggggacccggggggtaaccctaacgggtcggttacgggtaacgtaacgtaaacccgtaaaaccgggtaaccgtttagggtccgggacgttaccggaccgtaaacccttacgttacccgttacgtttaccccttcgtaaccgtttcccccg

SEQ ID NO: 3662 - DNA, 932 bp, Homo sapiens
  misc_feature: GYAE6OF01EF0Z3.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgaccagtctccagacctccctggctgtgtctcgtgggcgaggacggccacatcaactgacaacgtccacgaccagtagttcgttttaacacgtacggtaccaaactaaataaagtaactttacgttcgtacgttacggtaaccagacgaaacgaaaaccgaggaaccacgtcccttaccgttaaagttcgtccttacttaacgtttacggtcgggactacgttaccccgggtaacccgggggtaccgggttccccgggggttacccctacggtacccgtaacttcggacgggaccggaccgacgggtccggggtacgtagggaacgtaacgtacgttactttacccgaccttaccgtacccaaacctacgtaaccgacgaccgtaccggtcccgtacggaccggacgggtaactaacggggtaaagttacgggttagggttacgggttaaaccgtttttaacggtttttaaacttttaccggttaacggttacgaaggtttaaccgttaaagtttttaaacgtttaacgtttaacggttaacccgtttaccgttaaccgggttaaccgggttttttaccgggggttttaaccccggggggaacccggggttaaaccgttaacgggtaccgggtaaacggggtaaacgttaaaaccggtaaaacccggttaaaaaccggggttaccggttacggggttaccggtaacccttacccggtaacccgttaacccgttacggtttaccggtttacccgttttaaccctttcccgttaccccggttttaacccccccgg

SEQ ID NO: 3663 - DNA, 750 bp, Homo sapiens
  misc_feature: GYAE6OF01CTGFA.39.31.C09.1.454.CMB.1.raw
  modified_base (341)..(341): a, c, t, g, unknown or other
  misc_feature (341)..(341): n is a, c, g, or t
  modified_base (698)..(698): a, c, t, g, unknown or other
  misc_feature (698)..(698): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctcccgtggctgtgtctcgtgggcgaggagggcccaccatcaacgtgacaacgtccagaccaggtagttacgttttaaccacgtacggtaccaaaacaataaagtaactttacgtcgtcgttacggtaaccagacaacgaaaccgaaggaccagtaccctactaacgttcgactactatttacggnggactacgtccgtacccgggacggttcccgggtccctacggaccgtacgttcgacggacgggtcacgggtccggtcgtaggaacgtacgtacgttactttaccgaccttctaccgaaccacgttcgagcccgtacggtcccgtacggacggtacggacgtaacggtaaagtagttcgggtacggttacttaaggttttacttaccggtcgtacgacgttacgttaagttaatttacgtaacggtttacgtacccgttaacggtacggttttacccgggttaccggggaacccgggaactacggtccgggtaacggtaagaaacgttaacccgaaaacgttacgggtgtaccggtacnccggacccttaccgtacgttacgtttcctaacctttccgtcccgttaccccg

SEQ ID NO: 3664 - DNA, 686 bp, Homo sapiens
  misc_feature: GYAE6OF01EN5HI.39.31.C09.1.454.CMB.1.raw
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccagtagttgtttaacacgtaggtaccaaacaataagaattactcgacttggaccagacaagaaaaccgagacacgcctactaagtgctactagttactgggacatcccgtaccgggacgtccggggtcctaggaccgtatcgacgcggcgaggcgggtactggacgtacgagtattccgactcgtacaccgtatccaagccacgccgtagaccgtacggacgtacggaaagtacgtaggtaggtaacgttaacgttttaactttaccgtaggtacctaagtaccgtaagttaagtttaagttaacgttaccgttaccgttacgtaacggtttaaccgggttttacggggacccgggggtaaccgtaacggtacggtacgggtaaagtaccgttaaaccgtaaaacggtaaccgttgggtaacggtccgttacgaacccgtacctacgttacgtacgtttccttacgtacgttaccccg

SEQ ID NO: 3665 - DNA, 685 bp, Homo sapiens
  misc_feature: GYAE6OF01DLJXD.39.31.C09.1.454.CMB.1.raw
  modified_base (452)..(452): a, c, t, g, unknown or other
  misc_feature (452)..(452): n is a, c, g, or t
  modified_base (609)..(609): a, c, t, g, unknown or other
  misc_feature (609)..(609): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtgccgtacgggacatcgtgatgaccagtctccagactccctgctgtgtctctgggcgagaggccaccatcaactgacaagtccagccagagttcgttttacacgtacggtaccaaactaaataagtaactttaaccgttcgtaccttagggtaacccaggaccgaacggaaaaaccgaggaaccgacggtacccttaccgtaaagttcgaccttactacgttttaccggtcgggacctacgtaccggtaccccggggaggtcccggggtcctacggacccgtattcgagcggcacggacggtctagacgaacagtactttcaccgtctaccactntacgacgccacgtccgtgacgacgtacgtagaaagtgttagacgttacgttagtttactacggtctacgatactttaagttaacttaagtacgttaactccttaaacggtacggtttcgggttaccggggacccggaactacggtaggaaacgttanaacgtaaacgaaccggtaatggacgttcgtaccgacacgttacttaccggttattcgtaccgtacctttcccccgg

SEQ ID NO: 3666 - DNA, 740 bp, Homo sapiens
  misc_feature: GYAE6OF01A4832.39.31.C09.1.454.CMB.1.raw
  modified_base (212)..(212): a, c, t, g, unknown or other
  misc_feature (212)..(212): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtnttacacagtaccaacaataagtaattacttcgtcttgtaccagcagaaaccaggacagcctaccttaagttgtctactactttaacgtgggacagttccgtaccccggggacggttacccgggggtcccttaccgaccgtacttactacggaccggcgtacggcggggttcgttgaacgaacgagtatttacccgtacttcctacgaccctatccgaagccacgtccgtcgtacgacggccgttacgtaaaggacgttggcggttacgttaacgttttaacgtttaaccgttggttacacggtacgtagttaactttaagtacgtttaccggtacctttcgaacgtttaccggtttacgggggtacccggggtaaaccctacggtacgtacggggtaaacgtaaccgttaaacggtaaaaaccccggaacggttttagggtacccgggttcgtaacccggtaacccaaacccgtagttttaccctaccgggttttaccctttaaccggttaccgtttaacccccccgg

SEQ ID NO: 3667 - DNA, 610 bp, Homo sapiens
  misc_feature: GYAE6OF01DZ221.39.31.C09.1.454.CMB.1.raw
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggttcctacggggacatcgtgatgacccagtctccagactccctggctgtgtctcgtgggcgagagggccaccatcaactgcaagtccagccagagtgttttacacaggtaccaacaataagaattacttcgacttggtaccagcaagaaaccaggacagcctctaagttgctcatttacnggnagtcgtaccgggagtcccgggtcctgaccgtattcgagcggcacggtcgggtctgagacagtacttcgacttcacacatcagcagcctgacgacggactgaacgtagtgtaggtacgtaggttttaattacgtgtactagacgtaagttattaagtaggtacgttcctacgtacggtacgttttacggggacccggggtaaccgaacgtacgtagggagtacgttacgaaaaccggtaacgtcggttacggcttacggacccaaccttacgttacttacggttacctttaccgtaccgttccgttacccccg

SEQ ID NO: 3668 - DNA, 766 bp, Homo sapiens
  misc_feature: GYAE6OF01A7ESE.39.31.C09.1.454.CMB.1.raw
  modified_base (324)..(324): a, c, t, g, unknown or other
  misc_feature (324)..(324): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggacgggccaccatcaactgacaacgtccagccagtagttcgttttacacgacggtaccaaacaataagtaacttacttcgtcgttacggtaccagacaacgaaaccgaggacacgtcctacctaagttcacctacgtatttacgngggctacgtccgtacccgggtacggtcccgggtccctagaccgtattccgagccggacgacggtccggtactggaacacgaagttcgtttacacttaccaccacgtactacgaaccgcgtaaccgccgtagaccgtacgggtacgtaaggaacggttagtacgggttcggttaacgtttaacggttttttaactaacggtttcggacccttaaggtactttaacgtttaacgttacggtttaagttaacccgttccgtttaacggtaaccgggtttacccgggtttaccgggggaacccggggttaaccgtacgggtaccgggtaagggtaaacgtaccgttaaaaccgggtaaaaccggtacggtttacgggttcggaccgttaccgaccgtttaacctacggttccttaggtttaaccccttcggtccctttacccccgg

SEQ ID NO: 3669 - DNA, 671 bp, Homo sapiens
  misc_feature: GYAE6OF01CPD1L.39.31.C09.1.454.CMB.1.raw
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
  modified_base (640)..(640): a, c, t, g, unknown or other
  misc_feature (640)..(640): n is a, c, g, or t
  modified_base (649)..(649): a, c, t, g, unknown or other
  misc_feature (649)..(649): n is a, c, g, or t
  modified_base (656)..(656): a, c, t, g, unknown or other
  misc_feature (656)..(656): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtcctaccacgacctccctggctgtgtctcgtgggcgaggacggccaccataccaactgacaacgtccagccagtagttagtttaacacgacggtaccaaactaaataagtaacttactcgtcgttacggtaaccagacgaacgaaaccgaggaacacgccttaccgttaaggttcgtacctacttaagtttacgcggtacctacgtacccggtaaccgggcggttacccgggtcctacgacgtactcgnggccgcgaggccggttanacgagtactacgtacgttacactctactaccatccgagaccgactccgtagacggtagtccgtaagaagtgtcggtacgtacgttatttactgtacgtacgtagtactaaatttgtaacgtacgttaccttaccgtacggttaacggttccggttaaccgggggaccgttaacgagaccggttaagacgtaacgaacgtaaaggtaccgtggaccgtcgacacccgtntaccgttcncgttacncgttaaccgttcccg

SEQ ID NO: 3670 - DNA, 782 bp, Homo sapiens
  misc_feature: GYAE6OF01A64GH.39.31.C09.1.454.CMB.1.raw
  modified_base (180)..(180): a, c, t, g, unknown or other
  misc_feature (180)..(180): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtcctcagactcccgtggctgtgtctcgtgggcgaggnggccaccatcaactgacaacgtccagccagtagttacgtttacacgacggtacaaactaagtaagtaacttactcgtcgttacggtacagacaagaaccaggacacgacctactaaagtcgtacctctaacgtttacgtggtactacgtaccggtacccgggacggttcccggggtccctaggtacccgtataccgtacggccggacgacgggtccggtacgtacgaacgaacgacgttactttaccgaacttcctaccaaccacgttacgaacgcgtaaccgtaccgtcgaccggacggtcaaggtaacgtaggttcggtacggtacttaacggttttactacgttacggtaaccgaaggtaccgtaacgttttaagttacgttaaacggttcgttacccgttaacggtacgggttttaacccgggttaaccgggggtcccgggggttaaaacaccgggttacggttaaccgggaagtaaaccgttaaacccggtaaaacggttaaccggttagggtcgggttaaacctcccggttaaaccgaccggtttaaccgtacccggtttagtttccccctttaacgggcccttttaacccccggg

SEQ ID NO: 3671 - DNA, 795 bp, Homo sapiens
  misc_feature: GYAE6OF01CKXBA.39.31.C09.1.454.CMB.1.raw
  modified_base (117)..(117): a, c, t, g, unknown or other
  misc_feature (117)..(117): n is a, c, g, or t
  modified_base (358)..(358): a, c, t, g, unknown or other
  misc_feature (358)..(358): n is a, c, g, or t
tcagtcgcactagtcacgaccggtgctcgatttagacgtctcatcaaggaaggaagggcagcaagatggtgttgcagacccaggtcttcatttctctgttgctctggatctctggtncctacgggacatcgtgatcgaccagtctccagactccctggctgtgtctcgtggcgagacggccaccgatcaacgtcgacgaacgtccagccgaagtacgttcgttttaacaacgtacggttaccaaacgtaaagtaaagtaaacttacgtttccgacgttacgggtaaccaggtaccaaacggaaaccgacggaaccgtacgcccttacctaaaggttcacctacgtaacttttaccggngggtacctacgttacccgtaacccggggtaccggttccccggggttacccacggtaacccgttagttcccgaacgggtccggtaccgaacgggttccggttacctaggtaaccgaactaggttactttttaccaacgttccgtacctaaccgacgttaccgtaacgttacccgaacggttcccgttacggtaccgtaacgggtacgtaacggaaaaggttcgttagggtaccggttacgtttaaggtttttaaccgtaacggttacgtttaaccgagttaccgttaagtttaacgtttacggtacgttaccgttaccgtacgtaaacggtttccggtacggtaccggggtacacggtacggtgaacgtacgtacgaaacgtcgtaggtcgtacgtacgaccgtaacgtcgttacgttcgtaccttgtacgtttcccg

SEQ ID NO: 3672 - DNA, 746 bp, Homo sapiens
  misc_feature: GYAE6OF01AN858.39.31.C09.1.454.CMB.1.raw
  modified_base (334)..(334): a, c, t, g, unknown or other
  misc_feature (334)..(334): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcggtgagtcgacccagtctccagactccgtggctgtagtctcgtgggcgagagggccacgactcaactgacgaagtccgagccaggacgttcgttttacacgacggttaccaaactaataacgaatttaccgttcgactttaggtaccagacaacgtaacctaaggacacgtacctacttaacgttcgactacgtactttacgngggtacacgtccgtaccgggacggttccggggtacctacggtaccggtactaccgtacggacggacgacggtcggtccgttaggacgaacgtacggtactttacgtccgtacttaccgacgtacttacgacgtacgaccggtccgtcgtaccgagggtacctaggtaaacgatagggtcgtacgtaagttttaacgttacgtcgttacacgtacgtagttaaccttaggtaccgttacgttaccgtcgtaacggtttccgtttaagggggaccccgggttaacgaaggttccggaacggtacggtaacgttaaccggtaaaaacggttacgttcgggttaaacggtccgttacgggaccttaacgttaccgttaccggttaggtttccccttaagtacccgttttccccggg

SEQ ID NO: 3673 - DNA, 513 bp, Homo sapiens
  misc_feature: GYAE6OF01AOXVX.39.31.C09.1.454.CMB.1.raw
  modified_base (308)..(308): a, c, t, g, unknown or other
  misc_feature (308)..(308): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggngtccggggtccctgaccgattcagcggcagcgggtctgagacagatttcactctcaccatcagcagcctgcaggctgaagatgtggctagtttattactgtcagctagtattatagtagtcctctagtacgttttcggccggggtaccaggcgtggagatacgaaacgtactggtggctcgcacctactctatcttctattcccg

SEQ ID NO: 3674 - DNA, 570 bp, Homo sapiens
  misc_feature: GYAE6OF01BDXYZ.39.31.C09.1.454.CMB.1.raw
  modified_base (440)..(440): a, c, t, g, unknown or other
  misc_feature (440)..(440): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaataagaattacttcgcttggtaccagcaagaaaccaggacacgcctcctaagttgctcatttacgtggcacgtccgtacccggggagtcccggggtccctgaccgtattcagcggcaggcggtctgacgacagtactttcactctaccaccatcacgcagcctgcgaggctagaagtagtgtaggacttagtttacttactgtacagtntagtattagtagtacgtcctacgtagttaccggtttcgggacccggggtacaggtctaggacgtacgtaacgaaacgtacgttggtacggtctacgaccacctagttcttagttccttcgtacttccccg

SEQ ID NO: 3675 - DNA, 873 bp, Homo sapiens
  misc_feature: GYAE6OF01ECT6V.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctcccgtggctgtgtctcgtgggcgaggacggccaccatacaactcgacgaacgtccgacgaccagtagttacgttttaacacgtacggtaccaaactaaataaagtaatttaccgttcgtcgttacggtaccagaccaacgaaaccgagacacgtacctactaagtcgtctacttacgtttacgcggcctacgttaccggtaccggggtacggtcccgggtcccgtacgaccgtacgttcgacggcggaccgacggtcgggtacctacggacgtaacgtacgttaccttaccgtactacctactacctacgtaccgacgaccgtaccggtacggtacggaccggtacggtaacggtaacggtacggtttacgggtacggttacggtttaaacgttttaacgtttttaacccgttaggttaccgtaacgttaacgtaacgtttttaacgttttaaagtttacgggtttaacccggtttacccggtttaaccgtttaaccgggtttaccgggggtttttaacccggggtttacccgggggaaaccccggtaagggttaaccgttcgggtaaaacggggtacccttaaaccggtaaaaccgggtaaaccggtttcggttcccggggttaacctacccgggtacccgtaacccgtttaaccgttaccggttttaccgttacccctttacgttttaaccccgtccccggtttaaccccccgg

SEQ ID NO: 3676 - DNA, 741 bp, Homo sapiens
  misc_feature: GYAE6OF01DP453.39.31.C09.1.454.CMB.1.raw
  modified_base (285)..(285): a, c, t, g, unknown or other
  misc_feature (285)..(285): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagacctcctggctgtgtctcgtgggcgagacggccaccatcaactgacaagtccacgccagacgttggtttaacacgacggtaccaaacaagtaaagtaattacgttcgcgttaggtaccaggcaacggaaaaccgnggactacgcctacctaagttcgcttctaattttaccgcgggctaactccgtacccggggacgttcccggggtccctggaaccgtacttacgaggcggctacgggcgggtcttaggacgacgtacgtattttcccaatccgtaaccaccgtagtaccgacgaccgttaacgcccgtggaaccgtacgggtccttaaggaacgtagttcgggtaaccggtctttaagggttttaacttacccggtagggttcaagtttacgaaacggtttagttaaccgtttaagggaaccggtttccgtaccgtagggtttaacccgggttttccgggggaacccggggttaacccaagggttccgttacggaacgtttcggaaacctaaaacggggtaccttgggaccggttcgacgtacccccaaagtttccgtactttaccggtcttccccgtaacttccccgg

SEQ ID NO: 3677 - DNA, 744 bp, Homo sapiens
  misc_feature: GYAE6OF01ES6W0.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgaccagtcctccagacctccctggctgtgttctcgtgggcgaggacgggccaaccatacaactgacaacgtccacgaccagtagttcgttttaacacgtaacggtaccaaaacaaataaagtaattacttcgtcttacggtaaccagacaaacgaaaccgaggaacagcctacctaagttcgctactatttacgtgggctacgtccggtacccgggtacggtccccgggtaccctcggaccgtacgttacgacggacggcgacggtccgggtagtagaacgaacgtacgtactttaccacctcctaccaaccgtactacgagaccacgtacccgtgacgacggctaaggaagtattgggtacgtattaacgttttaagttacgtacgtacgtacgtactaagtttaattagtaacgttaaccggtacccttacggtaaccggttttacgggtttaccgggggtaacccggggtaaccgtaacgggtacgtaacgggtaacgtaaacgtaaaacgtaaaccggtacgttacgggttagggtacccgttacgacccctaaaccgttccgttacgttaccgtttcccttaccgtacccgtttacccccg

SEQ ID NO: 3678 - DNA, 711 bp, Homo sapiens
  misc_feature: GYAE6OF01BMV9M.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggcccaccatcaactgacaagtccagccagtagtgtttacacaggtccaaacaataagaattacttcgcttggtaccagcaagaaaccaggacagcctactagtcgctctatttacgtgggcacgttccgtacccggggtacggtcccggggtccctcggaccgtacttcgacggccggcgacggtccgggtactggagacgagtactttcacttcctactaccactacgacgaccacgtcccgtcggaccgacgggtactaggtaaacgtagttcgggtaggtacgttaagtttttacgttacgttcggtactaacggtacgttaagtttaatttaagttaacggttacgttacccgtacgttaacggtttaacggtttttaccggggaacccggtaacggggtaacccgaaggtaccggtaacgggaacgtaaaccgttaaaccggtaaaaccggtaacggttcggttccgggtacctacggtaccctaaccgttacgtttacccttcggtttcccttccgttaaccccg

SEQ ID NO: 3679 - DNA, 739 bp, Homo sapiens
  misc_feature: GYAE6OF01CQUSP.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctcgtggtgccgtacggggacatcgtgatcgacccagtcctccagacctccgtggctgtcgtctcgtgggcgaggacgggcccaccatccaactgacacgtccagccagtacgttcgtttaccacgtacggtacccaaataaagtaaagtaactttacgttcgtcgttacggtacccagacaagaaacccgaggaccacgtccctacgttaagttcgcctacttaacgtttacggtgggcctacgttcccggtaccccggggcggttccccggggtccctacggacccgtagttccgaggcccggacgacgggtccggtcgtacggacgtacgtacgtactttaccaccgttccaccgacacgtacacgaccgtacgcctacgcgacggtacgtaggtaacgtagttcgggtacggttaccgttagttttacgttacgtcggtactacggtacttaagtttacgttaagttacgttaccgttaccgttaccggttacgtttaccggggttttaccggggaacccgggtaccggtacgtaccggtaggtaacgtaacgtaaccgtaaacgtcggttacggtcggccgtcgaccctacgtccgtacgttcttccttccgtcttacccccgg

SEQ ID NO: 3680 - DNA, 819 bp, Homo sapiens
  misc_feature: GYAE6OF01EQWZ4.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagagttcgttttaacacgtacggtacccaaactaaataaagtaactttacctttcgtcgttagggtaaccagacgaacgaaaaacccgaagggaaccacgtaccctaccgttaaaaggtttcgccttactaagttttaccgtggggacctaacgttccccggttaaccccggggacgggttccccggggttcccccgtaggtaaccccgtaactttccgaacggtccgggacacgggtcggggttcctaggtaacgaacgaagttactttaccgtactccgtaccaacctataccgacgacctaacgccttggaccgtaaggcgttaagaaaggtacttgggtacggtcgttaacgttttagttaccgttaggtaccgtaagtaccgtttaaagttaatttagtaaccggttacgtttaacccgtacgtaacggtttaacccgggttttaccgggggaaccccggggttaactaaccggtagttaccggggtaaagtaaccggttaaaccgtaaaaccgggtaaccgtttacgggtaacggttcccgtaaccgacccgttaacccgttacgtttcccgttacgtttaccgttcccttaacgtttccccccgg

SEQ ID NO: 3681 - DNA, 765 bp, Homo sapiens
  misc_feature: GYAE6OF01C3X7O.39.31.C09.1.454.CMB.1.raw
  modified_base (237)..(237): a, c, t, g, unknown or other
  misc_feature (237)..(237): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtcgtctcgtgggcgaggacggccacatcaactgcaagtccagccagtagttgtttaacacgtacggaccaaanaaataaagtaactttaacgttcgactttaggtaaccaagaccgaaacgaaaacccgagggaacacggtaccctaccgtttaaaggttcgtaccttagtaaactttttaccggtcgggaccttaacgttaccccggtaaccccggggtaacgggtttacccggggggttcccccttaacggggaacccgtacttaccgaacggggtacggtccgaacgggtccggggtttactaggaacgaacgaacgttactttaccaacctctacccaaccagttacgacgtacgacgttacccgagaccggaaggtccaaggaaaggttacgtggtacggacctttaaggtttaatttccgtgtaaccgtagtacttaaagttacttaagttacgtaacgccttacgtacggtaccggtttacgggaccgggtaaccgtaagaccgttaggaacgtaaacgttaacgaaaaccggtctaaggtcgggcttacgaaccgtaactacttacgtaggttccttaagccctttaccccgg

SEQ ID NO: 3682 - DNA, 719 bp, Homo sapiens
  misc_feature: GYAE6OF01CEUZO.39.31.C09.1.454.CMB.1.raw
  modified_base (320)..(320): a, c, t, g, unknown or other
  misc_feature (320)..(320): n is a, c, g, or t
  modified_base (488)..(488): a, c, t, g, unknown or other
  misc_feature (488)..(488): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtggcgagaggccacatcaatgacaagtccagcagagttgtttacacaggtaccaaacaaataaagtaattacttcgacttaggtaaccagacaacgaaaaccgaggaacacgtacctaccgtaaagttcgtactcgtaacttttaacgnggggtacctaacgttcccggtaacccggggtaacggtcccggggttaccctacggaacccgtacttaccgaacggccgggacgtaacgggtccgggtacgtagaaacggactaacgttacttttaccaccttacctaaccgaacctatacgaacgccgtagtacccgngaaccgaggtactacggaaagtagttgtacgttaacgttaagttttaacttacttcgtacgtaagtacttaagttaacgtttaatacggttaaccgttaccttagtaaccggttacggtttaccggggacccgggtaacctaggacgttaggaacgtaaacgtaacgaaacgtacgttagttcgaccgtacgacgtaaccctgttacgttcttactaccttcgttaccccg

SEQ ID NO: 3683 - DNA, 637 bp, Homo sapiens
  misc_feature: GYAE6OF01E0BAY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggagggccaccatcaactgcaagtccagccagtagttgttttaacactaggtaccaaacaataaagaatttacttcgcttaggtaccagacaagaaaaccaggacagcctacctaagttgctactatttacgtgggctagtccgtacccggggtacggtcccggggtccctcggaccgtattccgaggtccggcgaggcgggtctagagacgatactttccactctaccaccatcacgcacgtaccgtgacgacgcgtaggaagtagtggtacgtattaacgtttattacgtgtaccgagtacgtaagttattaacggtagttacgtacctacgtaacgttacggttttacggggaccggggtaaccaggtcgaacggtagtaacgtaacgtaaacggtacgtagggtacggcgtacgaccaccgttacgttcgttaccgttcttcctacgttcccccg

SEQ ID NO: 3684 - DNA, 674 bp, Homo sapiens
  misc_feature: GYAE6OF01DM5YS.39.31.C09.1.454.CMB.1.raw
  modified_base (276)..(276): a, c, t, g, unknown or other
  misc_feature (276)..(276): n is a, c, g, or t
  modified_base (311)..(311): a, c, t, g, unknown or other
  misc_feature (311)..(311): n is a, c, g, or t
  modified_base (472)..(472): a, c, t, g, unknown or other
  misc_feature (472)..(472): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatcgacccagtctccagactccctggctgtgtctcgtgggcgtagagggccacctatcaactggacaagtccagccagagttagtttacactaggtaccaaacaataagaatttctcgtcttaggtaccagacaacgaaacnggacagtccgtactaagtcgactcgttattaccgngggtacacgttccggtaccggtacggttcccgggtcctacgacgtcttacgacggtcggtcgtacggtcggtacagaacgacgtagtacgtttccactcgtaccaccagttacgacgtacggtacgtcgtacgtaccggtaggtaccgtagtaaaccggtnttacggtacggtacgttacgttttactacgttacgtccgagtaccgttaacgttagttaagttacggtaaccgttcgtacgtaacggttacggttacgggaccgggtaacgtacgtggtacggaagtaccgtaacgaaacgtacgtggtacggtacaccgtaccgtaacgttcttacgtaccgttctaccgtgttacccccg

SEQ ID NO: 3685 - DNA, 752 bp, Homo sapiens
  misc_feature: GYAE6OF01BG5WH.39.31.C09.1.454.CMB.1.raw
  modified_base (443)..(443): a, c, t, g, unknown or other
  misc_feature (443)..(443): n is a, c, g, or t
  modified_base (684)..(684): a, c, t, g, unknown or other
  misc_feature (684)..(684): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctcccgtggctgtgtctcgtgggcgaggagggccaccatacaactgacaagtccagaccagtagttgttttaacacgtacggtaccaaacaaataagtaactttacttcgacgttcggtaccagacgaacgaaaaccgaggaccagccctactaagtcgactcgtatttacgtgggctacgtccggtacccgggtggtcccggggtccctagtaccgtattaccgaggccgagacggtccgggtacgtaggacgacgtagtactttccgaccttacgtccaacccgtanaccgacgaccacggtcccgtcggaccgacggtacctaggaaacggtacgttacgggtacgttacgtttaagttttaacgttacgttacggtaccgtagtaccgttaagtttaacgttaagtacggtttaaccgtccttaacggttacgggtttaccgggtttccgggggaacgggtaacccgtaggtaccggtaggtaaacggtactaaacccgggtaaacgtcggttacggtaaccggtnttacccggacccttaaccgtaccgtttacgttacgtttaacccttcccgttaacccggtttacccccg

SEQ ID NO: 3686 - DNA, 806 bp, Homo sapiens
  misc_feature: GYAE6OF01CZOF6.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtcctccagcctccctggctgtgtctcgtgggcgaggacggcccaccatcaactcgacaacgtccagccaggtagttagttttacacgacggtaccaaactaaataagtaacttacgtcgcgttacggtaacccagaccgaaacgaaaccgaggaacaccgtccctacgtaacgttgcctactacgttttacgcggactaaccgtacccgggtaccccggggtacgggtccccgggttcccacggtaacccgtacgtaccgacggtccgggacgacgggtccggggttactaggaacgttacgaacgttacttttacccaaccttcctactaaccactacgtaagacccgtacggcccgtacgtaccgaggtaccgttaaggaaacgtacggttaggaccgggttaacgtttaacggttttaaccgttcggttacggtacgtaacgttaacgtttaacgttaaatttaacggtttaacggttacgttacccgttaccgttaagggttacccgggtttaaccggggacccgggggttaacctagggtaccggtaacggtaagtaaaccgttaacccggaaaacggtacggttacgggtacggtccgttacggtaacccaccttaacggttaccttcgttaccctttccgtacccgtttacccc

SEQ ID NO: 3687 - DNA, 683 bp, Homo sapiens
  misc_feature: GYAE6OF01D7S10.39.31.C09.1.454.CMB.1.raw
  modified_base (677)..(677): a, c, t, g, unknown or other
  misc_feature (677)..(677): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtgccgtacggggacatcgtgatcgacccagtctccagacctcccgtggctgtgtctcgtgggcgaggacggccacatcaactgaacacgtccagacagtagttgtttaccagacggtaccaaacaagttaaagactttacgttaccgtcgtttacggtaaccagacaaacggaaaccagggaacacggtacccttacgttaagttccgacttacttacgtttacggtacggggacctacgttacccggacccggggtaccggttcccggggtacccctagaccccggtattccggaacggccggcggtacggtccggtcgtaggagtaacagttactccgtactcctacgacctactacgacggactacctgggccctagggacctaggtacgtaggtaacgtggtacgtacgggttacttaacgttagtttaccagtacctaggtacttaagttactagttaccgtaccgtacgtacgtttacggaccgggtttacgacgggttaccaggtcaggtacgaacgtacgagtgcgtaggctcgactactagtacttgactntacccg

SEQ ID NO: 3688 - DNA, 660 bp, Homo sapiens
  misc_feature: GYAE6OF01AW9SU.39.31.C09.1.454.CMB.1.raw
  modified_base (301)..(301): a, c, t, g, unknown or other
  misc_feature (301)..(301): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaaacaataagaatttacttcgcttcggaccagcaacgaaaccaggacacgcctctaagttcgctactatttacgnggctacgtccgtacccgggacggtcccggggtccctacggaccgtacttccgacggccggacgacggtcgggtcgtaggaacgacgaaggttactttccgaaccttcctaccacctactacgacgccgaacgtcccgtagacgacggtctaaggaagtacgttgggtacggtacttagttttactacgtgtacgagtctaagttattaagttagttccttacccgtagtacgggtttaccggtttacggggacccgggaactaggtacgtaggtacgtaaacctaaccggaaacggtacgttggacggtcctaacgcctaaaccgtcttccttaacggttcttcccgtaacgttccccg

SEQ ID NO: 3689 - DNA, 772 bp, Homo sapiens
  misc_feature: GYAE6OF01EZ6VZ.39.31.C09.1.454.CMB.1.raw
  modified_base (339)..(339): a, c, t, g, unknown or other
  misc_feature (339)..(339): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtctccagacctcccgtggtctgtgtcctcgtgggcgaggacgggcccaccatacaacgtgacaacgtccagacctagtagttacgtttaccacgacggtaaccaaaactaaataaagtaactttacgttcgacgttacggaaccagacaaacgaaaccgaggacacgtcctacgtaagttgctacgtacttagnggtcctacgtaccggtacccgggtacggtcccgggtcctacgaccgtatcggaaggtccggacgtacgggccggttacgtagaaacgacgtagttactttaccgaccgtacctaaccgaccttagtaccgacgtaccgacggtccgtacggaccgtaacggtaccgtaaggaacgtaaggttacggttacggtaacgttttaacgtttacgttaacgttcgtaacgtacgtaacgttaagtttaactttaacgtaaggttaccgttaaccgttacggtaacggtttaacgggtttaccggggaaccggggtaacctacgggtacgtacgggaaagtaccgtaaaaccgtaaacggtaacgttggtacggtcgtacccgtacgtaaaccgttacggttacttacgtttccttaccggttacccttaaccccggg

SEQ ID NO: 3690 - DNA, 705 bp, Homo sapiens
  misc_feature: GYAE6OF01CM2BM.39.31.C09.1.454.CMB.1.raw
  modified_base (311)..(311): a, c, t, g, unknown or other
  misc_feature (311)..(311): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccagtagttgttttacacaggtaccaaacaaataagtaattacttcgtcttaggtaccagacaagaaaccaggacagcctactaagttcgctactaactttacgngggactacgtccgtaacccggggtacggttcccggggttaccctcggacccgtaagttccgaggtccggacgaggtccggggtactaggaacgtacaagtactttccgacctctaccacctataccacgtacacgtccgtgacgacggcgtagaagtagtggtaggtaccttagtttacgtacgttcgacgtacgtactaagtttagtttaagttaacggttacgttaccctacgttaacgggtttaccggtttcgggggaacccgggggtaactaacggtaccggtaagggtacgtaaacgtaaaccggtaaaccgtaacggttggtaccgggtccgttaacgaccctaccggttacttcttaggtttacccttcgtaacccgtttacccccg

SEQ ID NO: 3691 - DNA, 780 bp, Homo sapiens
  misc_feature: GYAE6OF01DP2GC.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgaccagtcctcgagtcctccgtggctgtgttctcggtgggacgaggacggaccaactactacgaacgtagaccacgtaccacgacctaaggttacgttctttaacgacctaacggtaacctaaaacgaaagttaaacgttaacgtttaccgtttcggtacgtttacggaaccaggaaaccaacggaaaaccgaacggacctacgtaccttacgttacgttcgtacttacgttaagtttacgacggtacctacggtacccggtaccgggtccggtacccgggttcctacgaccgtactacggcggtcgacgacggtcggtacgtagaacgacttacgtactttacccacgttacaccgtaaccgtacgcgaacgtacgacggtaccgtaggaccggtacggtaccgtagggtaaacgtagtttacggtacgttagtttaaccgtttaacgtttacgtcgtacgtaaggtactttaagtttaacgttacgttaacggttaccgttacgtacggtttaacccggggtttaaccggggttaccgggaacgggtacgtaaggtaccgtaaggtacgtaacgtaaaaccggagttacgtacggtcgacactacctactacgtactttacccgtctacctcccggtacc

SEQ ID NO: 3692 - DNA, 770 bp, Homo sapiens
  misc_feature: GYAE6OF01DJ6AM.39.31.C09.1.454.CMB.1.raw
  modified_base (326)..(326): a, c, t, g, unknown or other
  misc_feature (326)..(326): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtctccagacctccgtgctgtgtctcgtggcgaggacggccaccatcaactgacaacgtccgagaccgaggtagttacgtttaaccacgtacggtaccaaaacaattaaacgtaaattaccttcgtacggttacggtaaccacgacgaacgaaaccgagaccacgtaccttacgtaagttcncgtacttacgtttacggtacggactacgtaccgggtaccggtaccgggttcccgggtacctacggaaccgttactaccgacgggcgacgcggtccggtgtacgaacgaacgtacgttacgtttaccaccgttaccacccgtacgtacgtaccgaactacgaccgtaccgtagggaaccccggttaggaaccgttaagggaaacttagggtcggtacgttaaccgttttacgtttacttacggtacgttaaacccgtaggttacttaaaagtttacgttttaacggtaaccgttccgttaacgtacgtacggttttaccgggtacgggaaccgggtaactaggtaccgtaagtacgtaaccgtaaacgttaacggtcgttagggacttcccgacaacgttaccttcggtaccgttatttaacccgttgtttaccctaacccccgg

SEQ ID NO: 3693 - DNA, 660 bp, Homo sapiens
  misc_feature: GYAE6OF01CGJGJ.39.31.C09.1.454.CMB.1.raw
  modified_base (330)..(330): a, c, t, g, unknown or other
  misc_feature (330)..(330): n is a, c, g, or t
  modified_base (368)..(368): a, c, t, g, unknown or other
  misc_feature (368)..(368): n is a, c, g, or t
  modified_base (441)..(441): a, c, t, g, unknown or other
  misc_feature (441)..(441): n is a, c, g, or t
tcagtcgcactagtcacgaccggtgctcgatttagacgtctcatcaaggaaggaagggggcagcaagatggtgttgcagacccaggtcttcatttctctgttgctctggatctctggtgccgtacggggacatcgtgatcgacccagtcctccagacctcccgtggctgtgtcctcgtgggcgaggacgggcccaccatacaactgacagtccagccagtagttgtttaaccacgacggtaccaaactaaataaagtaacttacgttcgtacgttacggtaccagacaacgaaaccaggaccagtcctactaagtcactactatttacgnggactacgtccgacccggcggtccgggtccacgaccgntcgagcggcaggtcggtcagacgacagtacttcactcctacacatacacgcacgctcgaccaggtcaggtaanagttggtacgtactttagtttactacgtgtacgagtaccgttagttaattaacgtcggttacgttacctagtaacggtttaccgggtttaccgggggaccgggtaaccgtagtaccgggtacggtaacgtaacgtaaccgaaaacggtcgttagggtccggtaccgtagtaccctaacttaccgttacttagttacccttcgtaacccgtttacccccg

SEQ ID NO: 3694 - DNA, 757 bp, Homo sapiens
  misc_feature: GYAE6OF01C54BQ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctcccgtggctgtgtctcgtgggcgagacgggccaccatcaactgcaacgtccagccaggtagttgtttacacacggtaccaaacaaataagtaacttacttcgtacttcggtaaccagacaacgaaaaccaggaaccacgtacccttacgtaagttcgccttctaacttttacgtcggggtactacgttacccggtaaccccggggtaacgggttccccgggggttaccctacggaacccgtacttccgacggccgggacacgggccggttccgtaggaacgtactacggtacttttaccgacctcctacccaactactacgacgaccgtacgcctcggcgtacggtactaagaacgtacgttcgggtacgtacgtttagttttaactacgttcggtacacggtacgttaagttaacgtttaagttacgttaaccggttcctaggtaaccgggtttccgggtttaccgggggaacccgggtactacgggtacgttaaggggaacgtacccttaaaccggtaaaacggtcggttagtaccgggcttaaccggactaaacccgtgttacccgttacgtttccccgtaatcccgggtttaaccc

SEQ ID NO: 3695 - DNA, 779 bp, Homo sapiens
  misc_feature: GYAE6OF01DUWZV.39.31.C09.1.454.CMB.1.raw
  modified_base (312)..(312): a, c, t, g, unknown or other
  misc_feature (312)..(312): n is a, c, g, or t
tcagtcgcactagtcacgaccggtgctcgatttagacgtctcatcaaggaaggaaggggcagcaagatggtgttgcagacccaggtcttcatttctctgttgctctgatctcgtggtcgccgtacggggacatcgtgatcgaccctagtccaccaacgtcctcccgtggctgtcgtcgtcggtgggcgacggacggaccaccactaccaacgtgactacgaccagaccaaggtagtttacgttaacacgtacgtaacaaactaaagtaaacgtacttacgttcgtcgttacggaaccagacaaacgaaaccnggactacgtcctacgtaatcgtactattaacgttacggcggacctacgtaccccgggtaaccggggtccggtaccccggttaccgacgtaaccgtacgtacggcggtaccgggaaccgtcgggtaccggttacgacgtaaacggacgttaacgttcctttaacccaaccgtttccaaccgactacgacgtaacgacgtaccgtcggacgacccggaggttacgtaacggtaaggtacggttcggttaacgtgttttaaacgggttacttacgggtatacccgtagtaatttaaagttaagttacgttaacgttaccgtacgttacgttaaccggggttttacgggttaaccggggacccgtaaacgtgggtaacgtacgggtaaacaaaccggtaaacgtaaacgggttcgtacgggtacgacctacgaacgtctaacgttcttagtaccctgtaccccttacccgg

SEQ ID NO: 3696 - DNA, 967 bp, Homo sapiens
  misc_feature: GYAE6OF01BYI23.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaatgcaagtccagccagtagttgttttacacaggtaccaaacgaaataaagtaattaacttcgtcttacggtaacccagacaagaaacccaggacacgacctaccgtaaagtttcgaccttactaactttacgtgggacctaacgttccggtaaccccggggtacggttccccgggggtacccctacgggtaacccgtaactttccggaacggccgggaccgtaacggggtccggggttactacgggaaacggaacctaaacggttacgttttacccaaccgttacctacccaaaccctacgttacgaaccgaccgtaacggtccccgttaggaccggtaacgggtaccgttaagggaaaacgttacggttcgggtttaacgggtaaccttttaaacggttttttaacgtttaacccgttaacggtttaaccgtaaacgggttaccgttttaaaacggtttttaaagtttaaacgggttttaaaccggggttaacccgttttaacccccgttaccgggtttaaaaccgggggttttacccggggttttttaaaccggggggggaccccgggggttaaaaccccgtaaagggttcccgggtaaacggggtaaagtttaaaccccgtaaaaaccgggtaaaaacccgggttaacccggttttaggggacccggggtttaaaccctaccgggttaaaccccaaaacccggtttacggttttacccgtttaaccgggttttaccccttaaaccgttaacccggtttttaacccccccggg

SEQ ID NO: 3697 - DNA, 804 bp, Homo sapiens
  misc_feature: GYAE6OF01CJ4VP.39.31.C09.1.454.CMB.1.raw
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggcttgtctctcgtgggcgaggacggcccacgatacaactgacaacgtccagccagtacgttacgtttacacgtacggtaaccaaacgtaaataagtaactttacgttcgtcgttagtaccagacaacgaacagacncgtcctacgtaagtcgctactagttcgnggactacgtccgtacccgggacgttcccggggtccctacggaaccgtacgttccggaacggccggtacggacgggtccgggttacgaaccggaacgtaaccgtaacggtttacctttaccctaaccgttacccctaccgtaaccctactacggaaaccgttcccgaacggttccccgtaggaaccggtaccggtaaccgtaaggtaaacggttacggtaggttccggtaaaccttttaggttttaccgtagtaccgggtataccggttagtagttttaacttaggttaacggttcctaacgttaccggttaggttacccggggtttccggggaacccgggtaaaccgtaggtaccggttaaaggtacgtaaacgtaacccggttaaaacggtccggtaacgggttcggtacccggtacgttaccccgtacgttaccgtaacgtttccggttaacctttacctccccgtttacccccgg

SEQ ID NO: 3698 - DNA, 832 bp, Homo sapiens
  misc_feature: GYAE6OF01BWSFD.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggactctcgtggtgccgtacggggacatcgtgatcgacccagtcctaccacgtacctcccgtggtcttggttgtcctcgtgggcgacggacggcccaacgataccaacgtcgaccaacgtccgagtccgtaggtacgtttcgtttaacacgtacggtaccaaaactaaagtaaacgtaactttaccgtcgtacgttacggaaccagacaaacggaaaaccgaggaactaccgtccttacgttaaacggtcgaccttaacgtacgttttacggcggggaccttacggttacccgggtaccccggggtaccgggttcccggggttccctacgggtaacccgttacgttccggaacggtaccgggacggtacgggtaccggggttctaaggaacgaacgtacgttactttaccgactccgtaaccaaccgtataccgacgacccgtacgtaccgtcggaccgtacgggtacgtaaggtaacggtacgttacggttacggtaacgttttaaccgtttacgttaacgtccgtaacgacgttacgttaagtttaaagttacgttaacggttaaccgttccgtaacggttaacggtttaccgggtttaccgggggaccgggttaacgtacggtcggttaagtaacgtaccgtaaaacggtacgtacggttaggacggtactaccggtaaccacgttacgtttacgtccggttaaccttcgtcccgttaccccg

SEQ ID NO: 3699 - DNA, 563 bp, Homo sapiens
  misc_feature: GYAE6OF01DOANU.39.31.C09.1.454.CMB.1.raw
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (386)..(386): a, c, t, g, unknown or other
  misc_feature (386)..(386): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagccagccagagtgttttacacaggtccaacaataagaattactcgcttggtaccagcagaaaccnggacagcctctaagttgctcatttacnggcatcaccgggatcccggggtcctgaccgtattcagcggcagcgggtctgagacagatttcactctcaccatcgagcagcctgacaggctgaaagntgtgctagtttatactgtcagctagtattatacgtagtcctacagttacttttgggcccggggtaccaaggccgttagggagacgttaccgaaaacggtaaccgtaggttcgggtaccttagggtacccaaccccgtaatttaccgtggtttaacccttcgtaaccttttcccccgg

SEQ ID NO: 3700 - DNA, 700 bp, Homo sapiens
  misc_feature: GYAE6OF01B1BMA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctggctgtgtctcgtgggcgagacggccaccatcaactgcaagtccagccagagttgtttaacacaggtaccaacaataagaattacttcgacttaggaccagcaacgaaaccaggacacgtcctaccgtaagttcgactactatttaccgtggactactacccggtaccggtacggtcccgggttacccacggtaccgattccgaacgcggacgaacggtccgggtacgtaggaaacgaccgaagtacttttaccaaccttctacctaaaccctactacgaacgaccacggtccctcggaccgtacggaccgtaaggtaagacgttaggtacgggtaaccttaagttttaacgttaccgttaggtaccgtacgtacgtaagttaacgtttaagtaagtttacggttacctacgtaacgtaccgttttacgggaacccggggtaaccgtagaccgtaggacgaagtaaccgtaaacggtaacttagggtacggtcgtacgtaccgtaaccgtacttactacgtttcctacctcgttaccccg

SEQ ID NO: 3701 - DNA, 587 bp, Homo sapiens
  misc_feature: GYAE6OF01BEAXZ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctggcgagaggccacatcaactgcaagtccagccagagttgttttacacaggtccaaacaataagaattactcgcttgtaccagcagaaaccaggacagcctctaagtgctcattacgtggcatcctacccggggagtccgggtccctgaccgattcagcggcaggccgggtctgacgacgagtatttcactctccaccactcagccacgcctgcgagcgtagaagtagtaggtacggacgttagtttacgttacgttgtacgagtacgtaacgttaattaagttacgttacgttacccttacgtacggttacgttttacggggacccggggtaaccgtaaggtcgtaggtacgtaacgtacgaaacggtacgttggtacggtctacgtacacctactcgttacttcttctcttaccccg

SEQ ID NO: 3702 - DNA, 782 bp, Homo sapiens
  misc_feature: GYAE6OF01CICFH.39.31.C09.1.454.CMB.1.raw
  modified_base (360)..(360): a, c, t, g, unknown or other
  misc_feature (360)..(360): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggacggcccaccatccaactgacaacgtccagccagtagttgttttaaccacgtacggtacccaaactaaattaaagtaactttaccgttcgtacgtttacgggtaacccagacctaaacggaaaacccgaggaaccacgtcccttaccgtaaggttcgaccttacgtaagttttaccggngggtacctacgttacccggtaccccggggtacggttccccggggtaccctacggaacccgtattccgacggccgggacgacgggtccggggttctaggaacgtacgtagttacctttaccgaccttcctacccgacctactaccgagcccgacgtcccgacggcggacggtacgtaacggaagtggtaggtacgttacgttagttttacgtacgttcggtacgtacgtacttagttaatttacgttacggttaccgttaccgttacgttacgggtttaccgggtttaccggggaaccccgggtaactacgggcggttaacggtaacgtaacgtaaccgttaaacgtacggttacggtacggtccgtaaccgtaccgtacgttaccgttcgttaccgtttaccttaccgtccccgtttacccg

SEQ ID NO: 3703 - DNA, 566 bp, Homo sapiens
  misc_feature: GYAE6OF01AG65F.39.31.C09.1.454.CMB.1.raw
  modified_base (295)..(295): a, c, t, g, unknown or other
  misc_feature (295)..(295): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctacctaagttgctcatttacgnggcagtccgtacccgggtaggtcccggggtccctcggacccgattcgagcggcgaggtcgggtctgagacagtactttcactctcacatcagcacgcctgcacggctagagatgtgctagtttatgtcgtcagtactagttattagttacgtacgtacctcgtacggttacgttttcgggaccggggtaaccacggtcgtaggacgtacgtaacgaaacggtacgtaggtcggcgtcgaccacgtacttctagttcttcgtacgttccccg

SEQ ID NO: 3704 - DNA, 744 bp, Homo sapiens
  misc_feature: GYAE6OF01D3HY8.39.31.C09.1.454.CMB.1.raw
  modified_base (217)..(217): a, c, t, g, unknown or other
  misc_feature (217)..(217): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtcgccgtacggggacattcggtgagttccgaccctagtcctaccagtacctcccgtgtcgtgtcgtctcggtggacgaggacggcccaacactacacgtnaccgagtaccacgtacgtaagtagtttacgtttaacacggtacgaacctactaaagtaagtaactttacgtcgtagttaaccgtacgacgtacgaaccgaacgagacgcgtcctacgttagtcactacgttgtaccggcggacttaccgtaccccggggtacgtccggggtaccccgtcgtaccgacgttcacggcggtcaggtccgggtaccgtagaacgtacagtactttacgaccttacaccgtacgtaacctcgtaaccgcgaaccgtacgtaccgtcgtaaacgggtcgtacgtaacggtagttacggttaacgtaccgttaaggtttttaaccctaacggtttacgttacggtaaaccggttacgtaagtttaagtttacgttaacgttaacgttaccgttaccgtacgttacggttacgggtacgggtacgtacgtacgtacgtacgtaacgtaacgtaacgtacgtacgtacgtcgtacgtacgtacgtacttacgttacgttccttccgtacgtaccg

SEQ ID NO: 3705 - DNA, 670 bp, Homo sapiens
  misc_feature: GYAE6OF01BOA6K.39.31.C09.1.454.CMB.1.raw
  modified_base (300)..(300): a, c, t, g, unknown or other
  misc_feature (300)..(300): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagtagttgtttacacgacggtccaacaataagattactcgcttagtaccagcaacgaaaccaggacagcctacgtaagtcgctactatttacgngggactacgtccgtacccgggacggtcccggggtcctaggaccgtattcgacgccggcaggtccgggtactaggacgactagtactttccgacttcctacgaacctataccgacgtcctacgtcccgtggacgacggtacgtaacgaaggtagttggtacggtactttaaggtttacgttacgttacgtacgtaacgtctaagttagtttaacgtaacgttacgttacctacggtacggttaccggttttaccggggacccggggtaacaacggtacgtacgggtaacgtaacgtaaccgaaacggtacgttagggtacggtctaccgacaccgttacttacgttaccgttaccttccgtacgttccccg

SEQ ID NO: 3706 - DNA, 743 bp, Homo sapiens
  misc_feature: GYAE6OF01B0Q05.39.31.C09.1.454.CMB.1.raw
  modified_base (326)..(326): a, c, t, g, unknown or other
  misc_feature (326)..(326): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctcccgtggctgtgtctcgtgggcgagacggccaccgatacaactgcaagtccagccagagttgtttacacgacggtaccaaactaaataaagtaactttacgttcgacgttggtaacccagacaaagaaacccaggacacggcctacgtaagttcgcctctagtttacgnggactacgtccgtaacccgggaggttcccgggtcctcggaccgtattcgaggccgacgtacggtcggtctaggaacgtacgaggttactttacgacttccgaacctaccgtactcacggtcaacgtcccgtacgaccggtacggtacctaaggtaacggtagttacgggtacgtaaccgtttaacgttttaacgttaccgttacggttaccgtaaggaccgttaaggttttaacttaacggtttacgttaaccgttcccgttacggttaaccgggtttaccggggtttaccgggaacccggggtaacctaagggtccggttaaggtaaccgtacggtaaacccgtaaaccggtcttaggacggtaccgaccgtacgtaaccctgtaccgttacttccgttccgtaccgttacccccg

SEQ ID NO: 3707 - DNA, 844 bp, Homo sapiens
  misc_feature: GYAE6OF01B1VU6.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctcccgtggctgtgtctcgtgggcgaggacggcccaaccataccaactgacaacgtccgagccaggtagtttcgtttaaccacgtacggtaaccaaacgtaaattaaacgtaactttaccgttcgtaccgttacggtaaccagaccaaacgaaaccaggactacgtccctacgtaacgttcgacttctaacgtttacgcgggtacctaccgttacccggtaacccggggtaccggttccccgggggtccctacggtaacccgttacgttccgacgggtccgggacgtacgggtccgggtactacggaacgtacgtacggttacgtttaccctactaccgtaccaacctacgtcgaacgaccgacgtcccgtaggacggtacggtacgtaacggaaagttcgttacggtacggttacgtttaacgttttacttacgttacgtacgtaacgtacgttaaacggtttaatttaacggttacgtttaccgttaccgttaacggttaacccgggttttaaccggggtttaccggggaacccggggttaaacgtacgggtaccggtaacgggtaacgtaaaccgttaaacggtaaaaccggttacggttaggtaccgggttcccgaacgtaacccctacccggtttaacttcccggtttacggttttacccttacccggttcccgtttacccccg

SEQ ID NO: 3708 - DNA, 676 bp, Homo sapiens
  misc_feature: GYAE6OF01C3L0V.39.31.C09.1.454.CMB.1.raw
  modified_base (135)..(135): a, c, t, g, unknown or other
  misc_feature (135)..(135): n is a, c, g, or t
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (638)..(638): a, c, t, g, unknown or other
  misc_feature (638)..(638): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtgccgtacgggacatcgngatcgaccctagtcctccgagtacccgtccctggtctgtcgtctcgtgggcgaggacggccacactacaacgtgacgaacgtccacgaccgaggtagtttacgttaaccaacgtacggtaccaaactaataaaggtaacttacgttcgtactacgtaaccagacgaacgaacaggcacgtcctactaagtcnctagtacttcgngactacgccgtaccggcgtccggcctagacctgtcgacggtcgcgtacgggtcggtactaagaacgtacgacgtttacctttccaaaccgtcctaccgtaaaccgtcgtaccgtacgtaccgtaccggtccacgggtacgtacggtacggtacgaaaggttcgttaggtaacggtacgtttacgttacgttacgagttacgacgttacgtattacgtataaccgtcgtcgtacggttacgtacgggttccggaacggttacctaggcgttacgagttacgaaacgtagtacgtggtacncgtacgacgacttacgtctagtttccagttccttcccg

SEQ ID NO: 3709 - DNA, 773 bp, Homo sapiens
  misc_feature: GYAE6OF01COMWQ.39.31.C09.1.454.CMB.1.raw
tcagtcgcactagtcacgaccggtgctcgatttagacgtctcatcaaggaaggaaggggcagcaagatggtgttgcagacccaggtcttcacttctctgttgctctggatctctggtgcctacggggacatcgtgatcgacccagtctccagacctccctggctgtgtctcgtgggcgagaggccaccatcaactgacaacgtccagccagtagttgtttaacacgacggtaccaaactaaataaagtaacttacgttcgtacgttaggtaaccagaccaacggaaaccgaggaaccacgtacccgttaccgtaaagttcgtacctactaagttttaccggtcgggtacctacgttacccggtaaccccggggtacggttcccccgggggttaccctacggaacccggtacgttaccgacgggccggaccgacgggtccggggttacgtaacggaacgtaccgtaagttactttaccgaaccgtcctaacccgaccgtacgtaccgacggtaccctaacggtccgttacgaccgtaacgggtacctaaggtaacggtacggttgggttaccggtaacgtttaggttttaacgtacgttacggtacacggtattaagttactttaacgttacgttaaccgttccgtacgtaacggtttccggttaccggggaaccgggaacctaggacgtacggaacgtaacgtaaccgaaacgtacgttggtacgtcgtaccgacctacgtacttcgttagttaccctcgtacccgttccccg

SEQ ID NO: 3710 - DNA, 746 bp, Homo sapiens
  misc_feature: GYAE6OF01D1ZKT.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtccagccagtagttgtttaacacgtacggtaccaaactaaataaagtaactttacttcgtcgttacggtaaccagacaacgaaaacccgaggaacacgaccttaccgttaacgttgcctacgtaacgttttacgtgggacctaacgttcccggtaccccggggtacggttccccggggttccctacggacccgtacgttacgacggccgggcgacggtcggggttctaggaacgactaaggttactttccaacttctaccaccctactccgacgccacgtccgtacgacgtacggaccgtaggaaagtacgttaggtcggtaagtttaacgttttatttacgttcgtacgtaagtacgttaagtttaactttaagttacggttaacgttaccgtacgtacgttaccgggttttacggggaacccggggtacgtaacggtcggtaagggtaacgtaccgtaaaccgtaaacggtaacggttcggtacggtccgtacgtacccaaccgttacttaccgtacgtttaccttcgttaccgttaccccg

SEQ ID NO: 3711 - DNA, 731 bp, Homo sapiens
  misc_feature: GYAE6OF01DKTIQ.39.31.C09.1.454.CMB.1.raw
  modified_base (153)..(153): a, c, t, g, unknown or other
  misc_feature (153)..(153): n is a, c, g, or t
  modified_base (194)..(194): a, c, t, g, unknown or other
  misc_feature (194)..(194): n is a, c, g, or t
  modified_base (306)..(306): a, c, t, g, unknown or other
  misc_feature (306)..(306): n is a, c, g, or t
tcagtcgcactagtcacgaccggtgctcgatttagacgtctcatcaaggaaggaagggcagcaagatggtgttgcagacccaggtcttcatttctctgttgctctggacttctcgtggtcgccgtacgggacagtcgtgatcgaccaggtccnccagcctccgtggctagtgtctcgagggcgaaggcggcccncgatcgaactggacacgtccagccgagtacgtttcgttaccacgtacggtaaccaataaacgttaagtaactttcgttcgtacgttacggacaacggtcaaacggaaaccgnggacgtacgacccgtttaacgtaaggtccgaccttagttaacgtttacggcggacttaacgtcccggtacccggggacgttccgggtaccctaggaaccgttacgtcgaccggtcgacccgagggtccgggtatacggaacgaaggtacttcgttcgaccttctacgaccttaagtccggaatccggtaccgccgcgtacgagtaccgttaacggacgtatccggttaggaaccttttaggttacttacgtcgttacgaaccgttagtaacttagtaaccgttcgtttaaccgtccgttaacggttacggtttacggtaccgggacccggtaacttagggacgttagtaacggacctaaacggtacgtaccgtggaacgttcgaacgtccgtactaacgttcggttacctacttcgcgtttaccg

SEQ ID NO: 3712 - DNA, 711 bp, Homo sapiens
  misc_feature: GYAE6OF01AONAX.39.31.C09.1.454.CMB.1.raw
  modified_base (300)..(300): a, c, t, g, unknown or other
  misc_feature (300)..(300): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagtgtttacacaggtaccaaacaataagaatttacttacgcttggtaccagcaagaaacccaggacagccctactaagttgctcatttacgngggcatccgtacccggggagtcccggggtccctgacccgattcgagcggcaggcggtctgacgacagtactttcgacctctaccaccatcgacgacgtacgcctggacgacggtccgtaggaaacgtattcgggtacggtcgttaaggttttacttacgttacggtacgtacgtaccgtaagttttaagtttaacgttacggttaaccgtttaccgtaccgttaacgggttacccggttttttaacgggggaacccggggggttaaccgtaaccgggtccggttaacgggtaagtaaccggtaaaccggtaaaaccggtaccggttacggggttacgggtccgttacccggtacccgtaaacccgtttactccggttacgttaccgtttaccgttacgtttacccccccgg

SEQ ID NO: 3713 - DNA, 923 bp, Homo sapiens
  misc_feature: GYAE6OF01DXAPC.39.31.C09.1.454.CMB.1.raw
tcagtcgcactagtcacgaccggtgctcgatttagacgtctcatcaaggaaggaagggggcagcaagatggtgttgcagacccaggtcttcatttctctgttgctctggatctctggtgcctacgggacatcgtgatgacccagtctccagacctccctggctgtgtctcgtgggcgaggacgggcccaaccataccaacgtcggacctaacggtccaacgcccgtaaggtacggtttacgttttaaccaccgtaacggtaacccaaaactaaaattaacgtaaactttaccgtttcgtacgtttacgggtaaacccaaggtaccgtaaaccggaaaaacccgtagggaaccctaacggtaccccttaccgtttaaaggttcgacccttacgttaacgttttaccggtcgggaccttaacggttcccgggtaaaccccgggggcgggtttccccggggtaccctacgggaaccttacgttaccgacgggccgggacgtacgggtccgggttacctaggaacgtaaccgtacggttacttttaccgaaccctttccgacctaaaccgtattaccgacgtacctaccggtaccctagggacgtaacgggtaccttaagggaaaacgttcggttagggttacggttaactttaacggttttaactttaccggtgtaacccggagttacgttaaagtttaagttaacgttaacggttccgttacccgttaacggttaacgggttttaccgggggttttaccggggaccccggggttaacgtaaggggttccggtaaacgggtaacgttaaccgtaaaacccggggttaaacggttaccgtccggggttaacggtaccgttaccggtacccctaaacccggttcttacccggtttaccgtttacccttagttcccccgtttacccccg

SEQ ID NO: 3714 - DNA, 775 bp, Homo sapiens
  misc_feature: GYAE6OF01EFOBD.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctcagactccctggctgtgtctcgtgggcgaggacggccaccatacaactgacaagtccagccagtagttacgtttacacgaggtaccaaacaataaagtaattacgttcgtcttaggtaaccagacaacgaaaccgaggacacgaccttactaagttcgactactaagtttacgcgggactacgtcccggtacccggggtacggtcccggggttaccctacggtaccgtacgttcgaacggccggacgtacgggcggggttctaggaacgaacgtacgttaacgttttccaacctttacctaaccgtaacctaaccgtaccaacggtcctaacgtcccgtacggaccgtaacggtacgtacggaaacgtaggttacggtcgggttaacgtttacggttttaacgttaacgtttacgtacgtaacgtaccgtaagtttaacgttaagttaacggttcgttaaccgttaacggtaaccgggtttaacgggttttaccggggaacccggggttaaccaacggtacggtaagggtaacgtaaaccgttaaccgtaaaacggtaacggttagggtacggtaccgtacgaccgtaaccgtcgttaccttacttaccgttctcccgttaccccgg

SEQ ID NO: 3715 - DNA, 712 bp, Homo sapiens
  misc_feature: GYAE6OF01BVQZV.39.31.C09.1.454.CMB.1.raw
  modified_base (341)..(341): a, c, t, g, unknown or other
  misc_feature (341)..(341): n is a, c, g, or t
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagacctccctggctgtgtctcgtgggcgaggacggccaccatcaactgacaagtccagccagtagttacgttttacacgacggtaccaaactaaataaagtaatttaaccttcgtacgttacggtaaccacgacaacgaaaccgaaggaccacgtcccttaccttaagttcgtccttactacgttttacgnggggacctacgttacccggtaacccggggtacggttcccggggtaccctcggacccgtacgttacgacggcggcgagggtccgggtcgtacggaacgacgtacgttacttttaccgaccttcctaccaccgtactccgaacgcacgtccgtacgccgtacggtcgtagtaaacgtaggtcggtacggtactttaacgttttatacgttcgacgtacgtatacgtttataagttacgtccgtacttacgtacgttacggtttccggggaccgggtaacacggtgtacggtaagtactaaccggtaaacgtacgttcggtacggtctacccgtactaacctgttccgttacgtttaccgtctaccgttccccg

SEQ ID NO: 3716 - DNA, 817 bp, Homo sapiens
  misc_feature: GYAE6OF01CQ3YG.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtcctccagacctcccgtggctgtgtctcgtgggcgaggacggccaccatcaactgacaagtccagcctagagttcgttttaacacgtaacggtaccaaacaaaattaagtaaactttacttcgtactttacggtaaccaggacaacgaaaaccgaaggacacgtacccttaccgttaagttcgacctcttaacgttttacgcgggtactacgttacccggtaaccccggggtacgtccccgggggttcccaggtaaccccgtattaccggacggacccggtacgacgggtccggggttcgtaggaaccgtacgtaagttactttacccgtaccttcctaacccgacctacgtaccgaacggtccgacgttcccgtacggacgacgggtacgtaacggtaaagtcgttaggtaacggttacgtttaaggtttttaaccgttaccgtttcggtaaccgtacgttaaccgttaagtttaacgtttaagttacgttacgtttacccggtacgttaccgggtttaccggggttttaccggggacccgggggtaacctacggtacggtacggtaacgtaaccgtaaaccgtaaacggttaccgttagggtacggtacctacggtaaccctaccgtacgttttacccgtcgtttaccttccccgttaaccgtttccccg

SEQ ID NO: 3717 - DNA, 854 bp, Homo sapiens
  misc_feature: GYAE6OF01C925A.39.31.C09.1.454.CMB.1.raw
  modified_base (136)..(136): a, c, t, g, unknown or other
  misc_feature (136)..(136): n is a, c, g, or t
  modified_base (753)..(753): a, c, t, g, unknown or other
  misc_feature (753)..(753): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgntgacccgagtctccagcctccctggctgtgtctcgtgggcgaggacggccaccatacaacgtgacaacgtccgacgaccgagtacgtttacgttttaaccgacgtaaccggtaccaaaactaaagtaaaacgttactttaccgttcgtacgttacggtaaccgagaccgaaacggaaaaccgaacggaacctaccggtaccctttacgttaaacgttcggtccttaactttaacgtttaccgggtacggtacctccggtttaacccggtaccccgggggtaccggggttacccccggggtacccgtacgggtacccgtttaacggttccgggaacggtcccggggtaccgtacggggtccggggttacctaaggggaaactaaacggtacgtttactttaccggtacccttccaacccaccgttaacgacgtaccggaccgtacgccgtaccggtaccgacgggtacgtaacgtaaggtacgtttcggttaacggttagtttaacgtttacgttacgtaccgttaagacgttaacgttaagtttaacgttaacgttacgtaccgtttactacggtttaacgggttaccgggtttaccgggggacccggttaaccggngtacgggtacgaaacgtcgtaaaccgtaacgggtcgtagggtccgtacgtccgtaccgacgttacttcccggttactttcctaccggttccttaaccccgg

SEQ ID NO: 3718 - DNA, 665 bp, Homo sapiens
  misc_feature: GYAE6OF01EABVH.39.31.C09.1.454.CMB.1.raw
  modified_base (308)..(308): a, c, t, g, unknown or other
  misc_feature (308)..(308): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctcctggctgtgtctctgggcgagaggccaccatcaactgacaagtccagccaagtagttgttttacacaggtaccaaacaataaagtaattacttcgcttggtaaccagacgaagaaaccaggacagtcctacctaagttgctactatttacgngggactacgtaccggtacccgggtacggtcccgggtcctgaaccgtacttcgacggtcggacaggacgggtctagagacagtactttacactctccacgatccagcacgccgtacgcgtacggtacgtaagaaaggtaagttggtacgggtacttaggtttaacttacgtcgtagagtaccgtaagtttaacgttaagtaagttaaccgttaccgttacgtaacggtttaccggtttttaccggggaacccgggggtaaccaagggtccgtaaggaacgtaacgtaaccgtaaacgaacgttaggcggtaccggtacgacctaaccgtacttacttagttccttactacttaccccg

SEQ ID NO: 3719 - DNA, 607 bp, Homo sapiens
  misc_feature: GYAE6OF01AJKNG.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagtgctcatttactggcatctacccgggagtcccggggtccctgaccgattcagcggcaggcgggtctgagacagtacttcactctaccactatacgacgcacgcctcgcgaggtctagaacgagtggtcgtacttaagtttacttacgtgtacgagacgtaagtttaattaagttaggttacgtaccctggtaacggtttaccggttttaccgggggacccggggtaaccgtaacgtccggttaggaacgtaactaaaccggaaaaccgtacggttaggcggtctacgaccctaactacttccgttcttacttcctcgtttacccccg

SEQ ID NO: 3720 - DNA, 605 bp, Homo sapiens
  misc_feature: GYAE6OF01EZ0AT.39.31.C09.1.454.CMB.1.raw
  modified_base (308)..(308): a, c, t, g, unknown or other
  misc_feature (308)..(308): n is a, c, g, or t
  modified_base (412)..(412): a, c, t, g, unknown or other
  misc_feature (412)..(412): n is a, c, g, or t
  modified_base (453)..(453): a, c, t, g, unknown or other
  misc_feature (453)..(453): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagaggccacatcaactgcaacgtccagccagtagttgttttacacgaggtaccaaacaataaagtaacttacttcgtcttacggtaccagcaagaaaccaggacacgcctacctaagttcgctactatttacgnggactactccgtacccgggtacggtcccggggtcctacgaccgtattcgacgcggctacggcggtacgtagacgactacgtatttcacgtcctacaccatcgancacgcctgcgaggtctagaacgtgtggtacgattaagtttntactgactagctaagttattagtacgtctctagtacgttcggtttacgggacgggtaccaggtcgtaggaacgtacaaggtaaaccgtgtggtacggctcgggtaaccaccgttacgttacttaccgttacccttacgtaccgtttaccccg

SEQ ID NO: 3721 - DNA, 803 bp, Homo sapiens
  misc_feature: GYAE6OF01DQ0Z8.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgccgtacgggacatcgtgatcgacccagtctccagacctcccgtggctgtgtctcgtgggcgaggcggccacataccaactgacaacgtccacgccgaagtagtttacgtttaaccacgacggtaccaaaactaaagtaaagtaactttaccgttcgtcgttacggtaaccagacaacgaaaccgacggaaccacgtcccttacgtaagttcgcctacgttacgtttacggcgggtacctacgtacccgggtacccggggtaccggttccccggggttccctacggaccgttacgttaccggacggccggtacgacgggtccgggtcgtacggaacgtaacgtaacgttactttaccgaaccttccgtaacccaacccgtagtaccgtaacgtacccgtaccgtccgtacggaccggtacggtaccgtaaggtaacgtaggttcggtaacggttactttaaggtttacgttacgtacgttacgaagttaccgttaagtttattaccgttaacgttacgttaccgtacggttaaccggtttccggggtttaccggggaacccgggttaaccgtacggtacggttaacggtaacgtaaccgttaaaccggaaacgttacggtggttacgtacccgtacgacctaaccgttacgttacttacgtttacccttccgttaaaccgttccccg

SEQ ID NO: 3722 - DNA, 800 bp, Homo sapiens
  misc_feature: GYAE6OF01D9GSX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagacctccctggctgtgtctctgggcgagaggccaccatcaactgacaagtccagccagtagttcgtttaacactacggtaccaaacaaataagtaactttacgttacgaccgtttacggtaaccaggacctaagtaaaacccaggaccacgtacccttaccgttaaagttcgaccttactttaaacgttttacgtcgggaccttaacgtacccgttaacccggggtacgggttaccccggggtcccttacggaaccgtatttccggaacgtcggcgaacggcgggtctagggacacgaagttactttaccgaccttaccgtacccaaccctagttaccgaaacgcctacggacccttcggaacgacggtactaaggtaaacggtacggttaggtaacggttcgttaacgttttaacgttaaccgttacgtaccgaagttaccgtaagtttaacgttagttaacggttaaccgttacccgtttacgtaacgttaccggttttacggggacccggggttaaaccgtaacggtaccgtacggtaaacgtaaccgttaaaccgtaaaaccggttacggtaggttaccgggcccttacggaaccttaccccgaacgtttaccgttacctttacgtttaccaccgttttaacccccg

SEQ ID NO: 3723 - DNA, 849 bp, Homo sapiens
  misc_feature: GYAE6OF01ESC2Z.39.31.C09.1.454.CMB.1.raw
  modified_base (118)..(118): a, c, t, g, unknown or other
  misc_feature (118)..(118): n is a, c, g, or t
  modified_base (833)..(833): a, c, t, g, unknown or other
  misc_feature (833)..(833): n is a, c, g, or t
tcagtcgcactagtcacgaccggtgctcgatttagacgtctcatcaaggaaggaaggggcagcaagatggtgttgcagacccaggtcttcatttctctgttgctctggatctctggtnccgtacggggacatcgtgatcgacccagtcctcagtcctcccgtgctgtgtctcgtgggcgaggcggaccaccatacaactgacaacgtccacgcacggtagttcgtttaaccgacgtaacggtaccaaaactaattaaacgtaacgtttacgttccgtacgtttacggaacccgtacgaaccaaaacggaaaacccgaggaacctaccgtacctaaccgttaaacggttcgtaccttagttaccgttacggtcgggactacgttaccccggtacccggggtaccgggttcccgggtaccgttacggaacccgtagttaccgaaggtaccggacggtacggtccgggtctacggaacgataacgtactttccgtaactcctaacctactacgtacgtacgacgacccggtacgtacgtcggtaaacggtccgtaaggttaaaggtacggttacggttacggttaacgggttaaactttttccgtaaacggttccggtaacgtaccggtaacttaaacggtttaacttaaggtaacgtttacccggttccgttaaccggttaaccggtttaccgggttaccccgggggaaccggttacgaaccgggtttacgggtaacgtaaccggtaacgtaaaaccggttaaaccggtacggttacggtacgtccgttaaccgaacccgttaccgttaccgttaccgttaattccccgtttaanacccgtttaccccccg

SEQ ID NO: 3724 - DNA, 787 bp, Homo sapiens
  misc_feature: GYAE6OF01AUQ09.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctcccgtggctgtcgtctcgtcgggcgagacgggccaccactcaactcgacaacgtccagccagtagttacgtttacacgacggtaccaaacgtaaataacgtaactttacgttaccgacgtttacggtaacccagaccaaacgtaaaccgtagaacacgtacctaccgttaagtgacctcttaacgtttccgtacgggtacctacggtacccggtaccccgggtacggttaccccggggtacccgtacgtaccgtacgttccggaacggccgggtacgaccggtccggggttactggaacgtacagtactttccgaccttaccgtacacctataccgaacgtctaccggtaccgtacgtacgacgtacgtacggaacgttacgtacgtacggtactttaaggtttaccgttaacttacggtaccgtagtaccgttaagtttaacgttacgttaaacggtttacgtacccgttacgttaacggtttaccgggttttaccggggaacccggggttaaccgtacggtaccggttacggaaacggttaaccgtaaacgtaaccgggtaacttcggtaacggtccgtcgaacccgttacctacgttccctttagttacttaccgttccgttaccccg

SEQ ID NO: 3725 - DNA, 793 bp, Homo sapiens
  misc_feature: GYAE6OF01AJR3X.39.31.C09.1.454.CMB.1.raw
  modified_base (179)..(179): a, c, t, g, unknown or other
  misc_feature (179)..(179): n is a, c, g, or t
  modified_base (203)..(203): a, c, t, g, unknown or other
  misc_feature (203)..(203): n is a, c, g, or t
tcagtcgcactagtcacgaccggtgctcgatttagacgtctcatcaaggaaggaagggcagcaagatggtgttgcagacccaggtcttcattctctgttgctctggatctctggtgccgtacgggacatcgtgatcgacccagtctccagactcccgtggctgtgtctcgtgggcgagnggccacatcaactgacacgtaccngaccagtagttcgtttacaacgacgtaccaaacgaataaagtaatttaccgttcgtccgttacggaccctacgacgaacgaaacccgaacggaaccgtaacgtaccgttaacccttaaggttcggtaacccttacgtaaacgttttacgtcggggtaacctaccgtacccggttaccccggggtacgggttcccggggtacccctaggtacccgtacttaccgaacggttcgggactacgggccggttccgaggtacgacgttacgtcttttaccgacctactccgacctacgtcgaacggtccgaccgtacgttcgaccgtacggtactaacgtaagtacgttacggtacggacttttacggttacggtttacttacgtacgtacgtaaccgttgttaacgttacgttaacttaccgttccgtaacggtccgggttttaaccgggtttaccggggaccgttaaccgggtacgtacgggtaagttcggtaaaaccgtacggtaaaccgttaaccggtgggttaggtcttaccggtaaccgaacgtttgttaccctttacgggttaaccttcccggttaattccccccggg

SEQ ID NO: 3726 - DNA, 736 bp, Homo sapiens
  misc_feature: GYAE6OF01ALQ37.39.31.C09.1.454.CMB.1.raw
  modified_base (320)..(320): a, c, t, g, unknown or other
  misc_feature (320)..(320): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagtactccctggctgtgtctcgtgggcgagaggccaccatcgaactgacaacgtccagccagtagttgttttacacacggtaccaacaataagtaactttactcgtacttaggtaacccagcaagaaaccaggaacagcctaccgtaagttcgacctctaacgttttacgngggactacgtccgtacccggggaagttccccggggtccctggtaacccgtatttccgagccggacgacggcggggttctaggaacggaacctagtaacttttcactaccgtacgacccagtccagtaccaccggtccgttcgaccgaggtaccgttacggaaacgtaacgttacggttacggtacgttaaggttttaacgtttaacgttacgtaccgtacggtaactaacggttaactttaagtaagtttaaccgtacccgttacggtaacgttaccggtttttacggggacccggggtaaccgaaggtaccgtaaggtaacgtaacgttaaccgaaaaccggttaacgtaggtacggtaccgtacggtacctaaccggttaacttacgttacgttccttaccgtactttaccccg

SEQ ID NO: 3727 - DNA, 847 bp, Homo sapiens
  misc_feature: GYAE6OF01EOMVF.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccgtggctgtgtctcgtgggcgagagggccacatacaactgacaagtccagccagtagttgttttacacgtacggtaccaaacaaataagtaatttacttcgtcttacggtaccagacaagaaaaccgaggacacgacctaccgtaaagttcgactactaacgtttacgtgggactacgttcccggtaacccggggtacggtccccggggtaccctacggtaacccgtagttaccgacggccgggtaccgacgggtccgggttacgtacggaacggaacgtaggtacttttacccgaaccttcctaccgaacccgtagttacccgaacggtccgaaccggtcccgttacggaccggtaacgggtaccgtaagggtaaacggtacggttacgggttacgggtaactttaacggtttttaacgtttaaccggtttacggttaccgtaacggtaccgttaaaggtttaacttttaacggttaacggtttaaccggttacccgttaaccggttaaccgggtttaaccgggtttttaccgggggaacccggggggtaaccgtaacggggtaccgttacggggtaaacgttaaccgtaaaccggtaaaacggtaaccggttgggttaacggtccgtaccggtaccctaacccgttacgttccgttaccgtttacctttaccgtacccgtttacccccg

SEQ ID NO: 3728 - DNA, 777 bp, Homo sapiens
  misc_feature: GYAE6OF01DZTQ8.39.31.C09.1.454.CMB.1.raw
tcagtcgcactagtcacgaccggtgctcgatttagacgtctcatcaaggaaggaaggggcagcaagatggtgttgcagacccaggtcttctatttctctgttgctcgtggatctcgtggtcgccgtacgggacagtcgtgatcgaccagtcctccacgtcctccgtggctgtgtcgtcgtgggcgaggacggaccacatacaacgtgacgaacgtccgacgccgtaggttacgtttacgtttaaccgaccgtaacggtaacccaaagtaaacgtaaacgttaactttaccgttcggtaccgttacggtaaccacggaaccgaaacggaaaccgaggacctacgtacccgttaacgtaggttctaccttacgttacgtttacggacggtacctacgtcccgggtaacccgggtccgggtcccggtactacgacgtacgtcgacggtcgacggcggtcggtcgacgacgaacgtacgttacttccgacttccgacctaactcgactacgacgacgtcgtacgcgtacggagtaaggacgttgtcggtaacgttatttaagtttacgtacgtcgtaacgaacgttagtaaacttttaggtaaacgttccgttaaccgttacgtccgggtttaagggttacccggggttacccggggaaacgaactcgggtacggtaaggtaccaaacggttaaaccgtaacgggttcgtagggcccgtacgtaacccgttactccggtttattcccggttaacgttcccttaacgcccgttttacccccg

SEQ ID NO: 3729 - DNA, 561 bp, Homo sapiens
  misc_feature: GYAE6OF01A9ZEA.39.31.C09.1.454.CMB.1.raw
  modified_base (348)..(348): a, c, t, g, unknown or other
  misc_feature (348)..(348): n is a, c, g, or t
  modified_base (551)..(551): a, c, t, g, unknown or other
  misc_feature (551)..(551): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatcgtacccgggagtcccgggtccctgaccgattcagcggcagcgggtctganagagatttcactctcaccatcagcagcctgcaggctagaagtatgtggcgtagtttacttacgtgtactagcgtagtacttaagttaacgttagtaccctacgtaggttacgttttacgggtaccgggggtaacacggcttagggaagtactaccgaaaacgtacgtagtacggtccgtgacgtacctagtcctagttccttntcgttacccg

SEQ ID NO: 3730 - DNA, 677 bp, Homo sapiens
  misc_feature: GYAE6OF01C0HDY.39.31.C09.1.454.CMB.1.raw
  modified_base (319)..(319): a, c, t, g, unknown or other
  misc_feature (319)..(319): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcccgtacggggacatcgtgatcgacccagtcctccagacctccctggctgtgtctcgtgggcgaggacgggcccaccatcaactgacaagtccagccagagttgttttaacacaggtaccaacaataaagtattacttcgcttacggtaaccagacaacgaaaccaaggacacgacctacctaagtcgactctatttacgnggtcacgtccgtacccggacggtcccgggtccctacgaccgtacttcgacggtcggcgaggtccggtctaggacaacgagttactttacaaccgtcctaccaccgtactacgacgcctacggcctacggaccgaggtcctaaggaaactggttcggttggactttagtttaacttagtcgttacagtacgttaagttacgttaacgttcggttaaccttccttaaccggttagttttacccggggttaccggggaacccggggtaactaagggttccggtaacggaaacgtactaaaccggaaaccgtaacggtgacggtctacgacctaacgtcttacgtacttctctaccgtcccg

SEQ ID NO: 3731 - DNA, 666 bp, Homo sapiens
  misc_feature: GYAE6OF01DWYRK.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaacgtccagccagtagttcgttttacacacggtaccaaactaataagtaattacttcgcttaggtaccagcaagaaaccaggacagcctactaagtgctactatttacgtcgggactacgtccgtacccggggtacggtcccggggttccctacggacccgtattccgaggtccgggcgacggtccggggtcctaggacgtaacacggtactttacaccttcctaccaccctataccgacgactacgcccgtgacgtacggtcgtaggtaacgtagttggtacgtacgttaacgtttacgttaccgtcgtacacgtactaagttaattacgtaagttccgtaccttacgtacggttaccgttttcggggacccgggtaacgtacggacgtaggtacgtaacctaacgaaacggtacgttggtacgtacgtccgacaccgtacttcttacttccttccgtcttaccccg

SEQ ID NO: 3732 - DNA, 872 bp, Homo sapiens
  misc_feature: GYAE6OF01DVI5E.39.31.C09.1.454.CMB.1.raw
tcagtcgcactagtcacgaccggtgctcgatttagacgtctcatcaaggaaggaaggggcagcaagatggtgttgcagacccaggtcttctatttctctgttgctctggatctcgtggtcgccgtacggggacatcgtgatcgacccagtcctaccagacctcccgtggctgtgtctgtgggcgagacggccacactcaactgacgaacgtccagacctaagtagtttacgtttaacacgtaacggtaaccaaaactaaattaaaggtaaactttaccgtttacggtaccgtttacggtaaccaacggaacccgaaacgaaaaacccgacgggaacctaccggtacccttaaccggttaaaggttctaaccgtactttaaacggtttaacgtcggggtaacttaccggtacccggtaaccccgggggtacgggttacccccggggttacccgtaacggtaccccggtaatttacccggaggaccgggacgtagggtaccggggttagaacgtagtaaccgtacgttaactttacgaaccttcctaacgaccctaactacgacgtaaccgtacgaccgtacgacgtaacggaccgtaaggtaaagtacggtaggttacgtacgtttaacgtttaacgttaccgttactacgtaacgtacggttaaagttaacgtttaacgttaacggttaccgttaacgttaccggttaaccggttaaccggggttttacccggggaccgggttaaaccgacgggttacggtaacgggtaaacgtaacggtaaacccggtaaaagttaaccgggtacggttacggaacgtaccggtacctaacctacgttacgttacgtttacccttccgtaaccctttcccg

SEQ ID NO: 3733 - DNA, 632 bp, Homo sapiens
  misc_feature: GYAE6OF01EHO1W.39.31.C09.1.454.CMB.1.raw
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagttgttttacacaggtaccaaacaaataaagaatttacttcgcttaggtaccagacaagaaaccagacacgcctcctaagttgctctactttacgtgggactacgttaccgtaccccggggtacggttcccggggtccctcggaccgtacttcgaacggcggccgaggtcgggtacgtggacgacagtactttcgactctcacactcacgcacgctgccaggtctagagagtgtgtcttagtttacttagtcgtcagtcgtaatttatagttagtacttccacgtaggttaccgttttcggggacccggggtaacacggtcggtaggtaacgtaacgtaacccggaaaaacgtacgtgggtacggtccgtaccgacctaaccctacgtttcgttaggttccctttaactcccgtttcccccg

SEQ ID NO: 3734 - DNA, 783 bp, Homo sapiens
  misc_feature: GYAE6OF01C4Y4S.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctcccgtggctgtgtctcgtgggcgagacgggccaccatcaactgcaacgtccacgccagtagttacgttttacacgacggtaccaaacaaagtaaagtaacttaccttcgtcgttcggtaacctagaccaaggaaaaccacggaccaacgtacctaccgtaagttcgcctacttacgtttacgtcggactacgtaccggtaccgggtacgggtccccgggtctcggaaccgtatcgcggccggcacggtcggtcagaacgtaacgacggtactttcaccgtcctaccgaactactacgaagccgtacgtccgtacgtcgacggtacgtacggaacgtagttcggtacggttacgttaacgttttactttaacgtcgttacacggtaccttaagttaacgtttaacgttagttaaccgtaccggttaccggttaacgttaaccggggttttaccgggaacccgggggttaaccgtacggtaccggttaaccggaaacgttaaaccggtaaaccggtaaaccgggtaacggttaccgggttaccggtaccgttaccggtaaccctaaacccttacggtttaccggtttaaccgggtttccccttaacgttacccccgttttaacccccgg

SEQ ID NO: 3735 - DNA, 758 bp, Homo sapiens
  misc_feature: GYAE6OF01AFG11.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaacgtccaagccagtacgttcgttttacacacggtaccaaacaattaacgaatttaccgttcgacttaggtaccagtacaagaaacccaggacacgacctaccgtaagtcgcctataacgttttacgcgggtactacgttacccgtacccgggggacggtttacccgggggtaccctacggtaacccggtatttaccgaacggccggtaccacgggtccggttacgtacggaaacggtacaacggttacgttttaccacctttacgacaccccgtaagtcgaacgccgtacggaccttcggacgtacgtcgtacgtaagtacgttaggtccggtaagtttaaggtttacctttacgtacgttacggacgtaccgtaagtttaacttagttaacgttaccgttacctaaccggttaacgttcggttttacggggaacccgggttaacgaaccggtacggttaggtaacgtaccgtaaagtaacccgaaagttccggtaacgttccgtacggtaaccctaaacgttcttaacgttacttacccttaagtccgttaacccccg

SEQ ID NO: 3736 - DNA, 830 bp, Homo sapiens
  misc_feature: GYAE6OF01AP0SX.39.31.C09.1.454.CMB.1.raw
  modified_base (179)..(179): a, c, t, g, unknown or other
  misc_feature (179)..(179): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgaggnggccaccatcaactgacaacgtccagccagtagttcgttttaacacaggtaccaaactaataagaactttacttcgtcttaggtaccagacaagaaaccaggaacagtaccctacttaacggttgccttactaagtttaccgtcgggactacgtaccgtacccggggtacggttccccggggtaccctacggaccgtacttacgacggtccggtccgacggtcggggtctaggaacgtaacgtagtactttaccaccttccgtaccaccctaagtaccgacgaccgtacggtcccgtcggtaacccgagggtaaccgtaagaaacgggttacgtttcgggtacggtaaccgttttaaggtttttacctaccgtttaggtacccgtaacgggttaaccttaaaggttttaactttaacgggttaacggtttaaccgtttaccccttaacggttaaccgggtttttacccgggtttacggggggaacccccggggtaaaccgtacgggttaaccggtaaggggtaaaccgttaacccgttaaaaccggtaaaaccgggttacgggttggtaccgggtaccttaacggtacccttaaacccggttactttccggtttaacgtttaccctttacgttaaccccggtttacccccg

SEQ ID NO: 3737 - DNA, 657 bp, Homo sapiens
  misc_feature: GYAE6OF01BQ0JE.39.31.C09.1.454.CMB.1.raw
  modified_base (300)..(300): a, c, t, g, unknown or other
  misc_feature (300)..(300): n is a, c, g, or t
  modified_base (341)..(341): a, c, t, g, unknown or other
  misc_feature (341)..(341): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagagggccaccatcaactgcaagtccagccagagttgtttacacaggtccaaacaataaagaattacttcgcttggtaccagcaagaaaccaggacacgcctacctaagttcgctctatttacgngggcagtccgtacccgggaggtcccgggtccctagaccgtnttacgaggccggcgacggcgggtctgagacagtatttcacgtctaccacactcacgcacgcctgacgacggctagaacgtagttggtacggtacttaagttttacttacgtaggtacgagtacgttaacgtttaatttaacgtaaggtttaccgttaccgttaccgaagggttttaccggtttccggggaaccccgggggtaactaggtccggtagggtaactacgttaaaccgaaaacggtaccgttagggcggtaccttacgaacccctacgttaccgttcgttaaccgttccctttaccgtacgtttcccccg

SEQ ID NO: 3738 - DNA, 815 bp, Homo sapiens
  misc_feature: GYAE6OF01A0LGX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagcctccctggctgtgtctcgtgggcgaggacgggccaccactacaactcgacaacgtccagccagtagttagttttacacgacggtaccaaactaaataaacgtaactttacgttccgtacgttacggtaccaagacaacggaaaccaggtacacgtacctaccttaagttacgtcttactaacgttttaccggtacgggtaccctagttacccgttaaccccgggggtacgggttacccccgggggtttcccgtacgggaaccccgtaacgtttaccggaacgggtccggggaccggaaccggggtccggggttaccgtacgggaacgtaacggaacggttaactttaccgaaccgttacctaccgtaaccctactcgaacgtcctaccgggtaccctcggaccgaggtccgtaaggaagtacgtcggtcggtacttacggttttattacgttcgtaccgagtactaagttatttaacgttacgttacgtaccttacgtaacgggtttacggttttacggggaccgggttaaccgaacgggttcgtaacgggtaacgaaccgttaaccggtaaaacggttaccggtaggttaacgggtcccgtaccgtaactacccgttaacttacgtttacgtttacctttacccgtcgttttaaccccccg

SEQ ID NO: 3739 - DNA, 651 bp, Homo sapiens
  misc_feature: GYAE6OF01DMFPH.39.31.C09.1.454.CMB.1.raw
  modified_base (299)..(299): a, c, t, g, unknown or other
  misc_feature (299)..(299): n is a, c, g, or t
  modified_base (635)..(635): a, c, t, g, unknown or other
  misc_feature (635)..(635): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttgttttacacaggtaccaacaataagaattactcgcttaggtaccagacaagaaaccaggacagcctacctaagtgctctatttacnggctagtccgtacccgggaggtcccggggtccctgaccgtattcgagccggcaggcggttactgacgaacagtactttcacctctaccacctatcgagcgacgtcctgcacggtccgtagaagtagtgtaggtacttacgttttattacgtgtcgtagtaccgtaagtttaacttagttaaggttaccgttaccgttacgtaacggtttaccggtttttacgggggacccgggggtaacctagggtcccggttaagggaaacgtaccggttaaaccaaaccggttaacgtgggtacggtccgtacgaccaaccgtagttaccgttagttacccttntaccggtttacccccg

SEQ ID NO: 3740 - DNA, 904 bp, Homo sapiens
  misc_feature: GYAE6OF01BSYA7.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaacgtccagccagtagttgttttaacacgtacggtaccaaacaagttaaagtaatttaaccttcgtacgtttacgggtaccaggaccaacggtaaacccgaaggacacggtacccttaccgtaaaggttcgtccttactaattttaccgtggggtacctacgttacccggtacccgggggtacggttccccgggggttacccctacggacccgtacgtttaccgacggccggtacgacgggtccggggttaccgtacggaacgaacgtacggttacttttacccgaacctttaccgtacccaaacccgtacgttaccgaacggtacccgtaaccgtcccgttaaggaccccgtaaggggtcccgttaagggtaaaacggtagtttacgggttacgggttaaccgtttaacggtttttaacccgtttaccggtttaggtaacccgtaacggtaaccgttaaacggttttaacgttaaggtttaaccggttcgttaaccccttacgggttaaccggggttttaacccgggttttaccggggggaaccccgggggtaacctacggggtaccggttaaggggtaaacgtaaaccgttaaacccgaaaaccgggttaccggttagggttaacgggtcccgttaacgtaccccgtaaccgttaccgtttacggttacccgtttcctttaaccgtcccgttttaacccccggg

SEQ ID NO: 3741 - DNA, 836 bp, Homo sapiens
  misc_feature: GYAE6OF01B14SQ.39.31.C09.1.454.CMB.1.raw
  modified_base (176)..(176): a, c, t, g, unknown or other
  misc_feature (176)..(176): n is a, c, g, or t
  modified_base (796)..(796): a, c, t, g, unknown or other
  misc_feature (796)..(796): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctcccgtggctgtgtctcgngggccgaggacgggcccaccatacaacgtcgacaacgtccacgccagtagttcgtttaacgacgacggtaccaaactaaataagtaacttacttcggtacgttacggtaaccagtaccaaacgaaaaccgacggaaccacgtaccctaccgttaagttcgtacctactaacgtttacgtcgggtactaccgttacccggtaaccccggggtaccggtccccggggttccctaacgggtaccctagttaccgacggtaccggcgtaacgggccgggtctaaggacgtaaccgtacgtttactttaccgacccgttcctacccgaacctaacgttacgaaccgccgaacgtccgtacgccgggtaaccgtcgtaaaggtacgtaacgtttggtaacggttacgtttaagttttaacgtaaccgttacgaccgtagttaacttaaagtttaacgtttaaggttcgttacccggttccctaacggttaaccggttttacccggggttacggggaaccccgggtaacgtacggtacggtaacgggtaaacgtaaccgaaacccgggttaaaacggtcgttaccggggtaccgtcgaaccccgttacccgtaataccccgggtttnttttaacccggtcctttaacggtacccccgtttaccccgg

SEQ ID NO: 3742 - DNA, 821 bp, Homo sapiens
  misc_feature: GYAE6OF01B3EE3.39.31.C09.1.454.CMB.1.raw
tcagtcgcactagtcacgaccggtgctcgatttagacgtctcatcaaggaaggaagggggcagcaagatggtgttgcagacccaggtcttcatttctctgttgctctggatctctggtgccgtacggggacatcgtgatgacccagtctccagacctccctggctgtgtctcgtgggcgaggagggccaccatcaactgcaagtccagcagagttagtttacacacggtaccaacaataagtaattacttcgctttcggaccagacaacgaaaccaggacacgcctacctaagtcgactctatttacgtcgggctacgtccgtacccggggcggtcccggggtcctacggaccgtattacgacggccggacgacggccgggtctacggagacgtatactttaccacttccgtaccaacctactacgacgaccgtacggcccgttacggaccggtacggtacgtaaggtaaacggtacggttacgggttacgggttacgtttaaacggttttttaacgtttaacgttaccgggttaacttaacgggtacgtttaaacggttttaagttttaaacgttaacgggttttaaccgttacccgttttaaccggtttaacgggtttaacccgggggttttttaccggggggaacccccgggggttaaaccggtaacgggttaccgggttaaagggtaaaccgtaacggttaaaacccgggtaaaaaccgggttaccgttaacggggttcgggtacccgttaaccggaccctaacccggttcgtttacccgttaccggttcccgtttccttaacccgtttacccccgg

SEQ ID NO: 3743 - DNA, 713 bp, Homo sapiens
  misc_feature: GYAE6OF01B1WWW.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgcctacgggacatcgtgatcgacccagtctccgagacctccctggctgtcgtctcgtggcgagaggccaccgatcaactggacaacgtccagccaaggtagttcgtttacacgacggtaccaaacgtaataagtaactttactcgtacgtttacggtaaccacgtaacaacgaaaaccgtggaacctacggtcccttaccgtaagttcgccttacgtacttttaacgtcggggacctacgttcccggtaaccccgggtgggttaccccggggttcctacgaaccccggttagttacccggaggccggtacgacgggtccggtctaggactacgagttactttaccgaccttcgactacgtactccgtaagtaccgccgtaccgtcgacgtacgtacgtacggaaacgtaggtacggtgtaccgttaagtttactacgttctacgtaacgtcgtaagtagtttacgtaacgtctaccgtagtacgttacggttcggggaccggtaacgtacgtagtcggtaacgtacgaaccgtaaacgtcgtaggttacggaccttcgacgttacctcgtaccgttgttcccttcgtaccgttcccg

SEQ ID NO: 3744 - DNA, 725 bp, Homo sapiens
  misc_feature: GYAE6OF01CHMS2.39.31.C09.1.454.CMB.1.raw
  modified_base (313)..(313): a, c, t, g, unknown or other
  misc_feature (313)..(313): n is a, c, g, or t
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgaggagggccaccatcaactgacaagtccagccagtagttacgtttaacacgtaggtaccaaacaaataaagtaacttacttcgtacgttaggtaaccagtcaacgaaaccaggacacgcctaccttaaaggtcnctacacgtttacgnggcacgttaccgtaacccgggnggtcccggggtcctaggaccgtattacgcggcggacaggccggtcaggaacgacagtacttccgaactcctacaacctatccgaagcctaacgtccgtcgtacgacggtaccgttaggaaacgtagttacggtacgggtaacgtttaagttttaacgtttacgttacggtaccgtaacgtaccgtaagtttaagtttaacgttaagttacgtacccgttacgttaacggttaccggttttacggggaacccggggtaacgtacgggtacgtacggggtaacgtaacgtaaacgtaaaaccggtacggttaggtacggtaccgtacgtaacccgtaacgtacttacgttacgtttaccttcgttacgtttacccccg

SEQ ID NO: 3745 - DNA, 649 bp, Homo sapiens
  misc_feature: GYAE6OF01B9Y07.39.31.C09.1.454.CMB.1.raw
  modified_base (445)..(445): a, c, t, g, unknown or other
  misc_feature (445)..(445): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgttttacacgaggtaccaaacaaataaagaatttactcgtcttaggtaccagacaagaaaaccaggacagcctacctaagttcgctactatttacgtgggcctacgtaccgtaccccggggtacggtccccggggtccctacggtacccgtacttccgacggccggacgacggtcggggtctaggaagacagtactttacgactctccacactcagccacgcctgcgaacggntacgaagtgtggtggtacttaagtttactacgtgtacagtctaagttaacttaagtacgttacttaccttacgtacggtttaccggtttaccggggacccggggtaacctaggtccgtagggtaacaacgtaacgaaaacggttcgtaggtcggtactccgaactacccgtatttccgttagttaccttcgaacccgtttcccg

SEQ ID NO: 3746 - DNA, 717 bp, Homo sapiens
  misc_feature: GYAE6OF01CDWSU.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctcccgtggctgtgtctcgtggcgaggacggccacactacaactgacaacgtccacgccgagtgttacgtttacaacgtacgtaccaaactaataagtaattacctcgtacttacggtaaccagacgaacgaaaccgaggaaccacgtccttaccgtaagttcgtactacttacgtttacgcggactacgttccggtacccggggaccggttcccgggtccctacgtaccgtacgttcgacggccggacgtacgggtccggtacgaggaacgtacgtacgttactttccgaccttccgaccacctaagtcacgcgtacgtccagtaccgacggtctaaggacgtcgtggtacgtactttagttacttacgtacgtagacgttacgtaagttaacgtttagtacgtttccgtaccttaggtacggtttaccgggtttacggggaacccggtagtacgacggtacggtaacgtaaacctaacggaaaccggtttacgtacggttaacggtcctaaccgaccttacgttactacgtttaccttaccgttactcccggttaacccc

SEQ ID NO: 3747 - DNA, 769 bp, Homo sapiens
  misc_feature: GYAE6OF01BLZQW.39.31.C09.1.454.CMB.1.raw
  modified_base (299)..(299): a, c, t, g, unknown or other
  misc_feature (299)..(299): n is a, c, g, or t
  modified_base (324)..(324): a, c, t, g, unknown or other
  misc_feature (324)..(324): n is a, c, g, or t
  modified_base (405)..(405): a, c, t, g, unknown or other
  misc_feature (405)..(405): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatgacccagtctccagacctcccgtggctgtgtctcgtgggcgaggacgggccaccatccaactgacaagtccagaccaggtagttcgttttaacacgtaggtaccaaaacaaagtaaagtaacttacttcgtcttaggtaccagacaacgaaacacggacacncctacgtaagttgctactattacgnggtacacgtccggtacccggggtcggttcccggggtcctacgaccgtagttccgacggccggacggtacggtcggggtacncgggaaacgacgtacggttaactttaccaccgttccaccctacctaagttccgacgtcccgacggtacccgtgacggacggtacctaaggaagttaggtaccggttgggtactttaaggttttacgttacgttacgtacgtaacgtccggttaaagtttacttaacgttaacggttacgtttaccgtaaccgtacgggttttacgggtttacccgggaacccgggggtaactaaccgggttggtaacgggtaacgtaaccgttaaagaaacccgggttaacggttcgggacggttcccaacggtacccctaacgttacccggtttcgtttaccgttacctttaccgttaaccccgttcccccgg

SEQ ID NO: 3748 - DNA, 602 bp, Homo sapiens
  misc_feature: GYAE6OF01C7PAG.39.31.C09.1.454.CMB.1.raw
  modified_base (350)..(350): a, c, t, g, unknown or other
  misc_feature (350)..(350): n is a, c, g, or t
  modified_base (541)..(541): a, c, t, g, unknown or other
  misc_feature (541)..(541): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggagggccaccatcaaactgcaagtccagccagagttgttttaacacaggtaccaacaataaagtaataacttcgcttaggtaaccagacaagaaacccaggaccagacctacctaagttgctctatttacgtggcactcgtacccgggagtcccggggtcctgaccgattacngcggcaggcggtctggagtacagtactttcactctcaccatcaagtacaggtccctgacacggtctaggtaaagagtggtacggtaacgttagttttacttaacgtcgtacctagactaacgttaatttagttagttaacgtccttacgaacgttacgttttcgggaccggggtaaccaggtcgtaggaanacgtacgaaacgtaattcggtggactagaccaacacttactgttacttcctgttacccccg

SEQ ID NO: 3749 - DNA, 815 bp, Homo sapiens
  misc_feature: GYAE6OF01DDKOU.39.31.C09.1.454.CMB.1.raw
  modified_base (772)..(772): a, c, t, g, unknown or other
  misc_feature (772)..(772): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgagacgggccaccactcaactgacaacgtccacgccaggtagttgttttaacacgtacggtaccaaacaaataaagtaacttacttcgtcgttacggtaaccagacaacggaaaccacggacacgccttaccgtaagttcgctactatttacggtcggacacgtaccggtacccgggacggttccccggggtcctacggaccgtacttacgacggccggtacgacgggtcggtcgtaggacgtaacgtacggttacttttaccaccgttccctaccaacctacgtaccgacgtacgacggtccgtcgacgacggtcgtaacgaagtacgtgggtacgtaacgttagttttaactcgtcggtactacggtacttaaggtttaatttaacgttaacggttaccgttaccctaacgggttaacggtttaccgggtttaccggggggaaccccgggttaacgtaacggggtaccggttaacggggaaaccgtaaaccggttaaaacccgggtaaaacgggttaaaccgtttcgggggttaccgtaacccggttaccgggaaacccttaaacccggttacttttaaaccccggggtttntttaacccccggtttaccggtaacccccgtttttaccccccgg

SEQ ID NO: 3750 - DNA, 850 bp, Homo sapiens
  misc_feature: GYAE6OF01CRI50.39.31.C09.1.454.CMB.1.raw
  modified_base (434)..(434): a, c, t, g, unknown or other
  misc_feature (434)..(434): n is a, c, g, or t
tcagtcgcactagtcacgaccggtgctcgatttagacgtctcatcaaggaaggaaggggcagcaagatggtgttgcagacccaggtcttcatttctctgtgctctggatctctggtgccgtacggggacatcgtgatcgacccagtctccagacctcccgtggctgtgtctcgtgggcgaggacggaccaccatacaactgacaacgtccagccagtagttgtttaacacgtacggtaccaaaactaaataaagtaacttacgttcgtcgttagtaccagacaacgaaaccgaaggaccacgtccttacgttaagttcgctactaagtttacggcggacctacgttacccggtaaccccggggtacggtccccggggttcctacggtaccggttacgttaccggaggtaccggcggtacgggtcccggggttanacggaacgtaacgtacggttacttttaccgacctctaaccgacctacgtaccgaacgtccgaccgtccgtaacggcgtaacggtacgtagggtaaaccgtggttcggggtttaacgttaacgttttaacggttttttacgtaacccgggtttcggaaaccgtttacgggttaacgtttaaacttttagtttaaacgtttacgggtttaacccgttcgttaccggtttaaaccgggtttcccgggggttttaaccgggggaaccccgggttaaaccgacggttccgggtaaaaggtaaccctaaaacggttaaaccgaaaacggtttcccgggttagggtaacgggtccccttaacgaccccgtaacgtttaccgttcgtttaacgtttacccctacgtttaccccttaccccccgg

SEQ ID NO: 3751 - DNA, 685 bp, Homo sapiens
  misc_feature: GYAE6OF01AK3D9.39.31.C09.1.454.CMB.1.raw
  modified_base (333)..(333): a, c, t, g, unknown or other
  misc_feature (333)..(333): n is a, c, g, or t
  modified_base (407)..(407): a, c, t, g, unknown or other
  misc_feature (407)..(407): n is a, c, g, or t
  modified_base (466)..(466): a, c, t, g, unknown or other
  misc_feature (466)..(466): n is a, c, g, or t
  modified_base (529)..(529): a, c, t, g, unknown or other
  misc_feature (529)..(529): n is a, c, g, or t
tcagtcgcactagtcacgaccggtgctcgatttagacgtctcatcaaggaaggaaggggcagcaagatggtgttgcagacccaggtcttcattctctgtgctctgatctctgtgctacgggacatcgtgatcgacccagtctccagacctccctggctgtgtctcgtgggcgtaggacggccaccgatccaacgtcgacaacgtccgacgccagtagtttcgtttacacgtacggtaccaaacaaagtaagtaagttacctcgtacgttacggtaccaagtccaagtaaccgaggtacactcctacgtaagtcgtacctacgtacttttacgnggactcgtacccgtaacccggggcggttcccgggtaccacgtaccgtatcggaacgtcgcgacggtcggtccgngtaacgacaagttctccgtactccgtacacctagtcaaccggcaccgtaccgtgaacgnggtctagaacgtagtcgtagttaccgttaattcgttaagtctacggtatacgtagttaacttnttaaacgttcgtaccgttacgtacgtttacggtcggtaccggtaagaacgtcgtaagggtactaacgttacccgtaaaaggtccgttaggtacggtaccgtacggtaccccaaacggtcttacggttacccttacgtttcccgtctttacccccgg

SEQ ID NO: 3752 - DNA, 926 bp, Homo sapiens
  misc_feature: GYAE6OF01DAAWF.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtcgtctcgtgggcgagacggccaccactacaactgaccaacgtccacgtaccgagtacggtttacgttttaaccgaaccgtacggtaaccctaaaacgtaaacgtaaaagttaactttaaccgtcgttccgtttaacggtaacccacgaaccgaaacgaaaaccgaacgggaacctaccgtacccttaccgtaaggttccgaccttacgttaaccgttttaccggtcggggtacctaaccgttacccgggttaaccccggggtaccgggttacccccgggggtttcccgtacggaaccccggtttacgttaccggaccggtccgggacgtacgggtccgggtcgtacggaacgtaacgtagtaaccgtttcctaaccttccctaactacccgtaagtacccaagggtccctacggtccccgtaaggtccggtaaccgggtacgttaaaaggaaggttaccggttggttaaccggttaagttttaaaccggttttctttaacccgtaggttaaccgtaccgtttagttaaacggttttaaccgtttaaagggtttaacggtttaacccgttaacccgtttaaccggggtaacccgggttttaaccggggttacccggggggaccccgggtaaacggttccggtaccggggtaaagttaaagtaacccggtaaacgtaaaccggtacgttcgggacgttccgacgtaaccccgtattacccgttcgttaccgttaccctttaccggtccgtttaaccccccg

SEQ ID NO: 3753 - DNA, 718 bp, Homo sapiens
  misc_feature: GYAE6OF01CGW0P.39.31.C09.1.454.CMB.1.raw
tcagtcgcactagtcacgaccggtgctcgatttagacgtctcatcaaggaaggaaggggcagcaagatggtgttgcagacccaggtcttcgatttctctgttgctctggatctctggtgcctacggggacatcgtgatgacccagtctccagactccctggctgtgtctcgtgggcgagagggccaccatcaactgcaacgtccagccagagttcgttttacacaggtaccaaacaataaagtaattactcgtcttgtaccagcaagaaaccaggaacaggcctaccgtaaagttcgactcaactttacgtgggtcacgtccgtaacccggggacgtaccccgggggttcctacggaacccgtacgttccgacgcgggacgacggtcggggtctggaacgactaaggtacttttaccacgttcctaccgtaaccaacttccaacgtccgaacggtcccgtacggaccgtaacgggtcgtacggtaacggtaacttggtacggtacgttaagttttaacttaacgttcgtacgtacgtaccgtaaggttaatttaacgttacggttacgtaccgttacgtaacggttacggtttacgggaacccgggggtacctaaggtccgtaaggactaacgttacgaaacggtaacgttagggtacggtaccggtcgtaaccctaccgtagttaccgtacgtttaccgttaccgtcgttaccccgg

SEQ ID NO: 3754 - DNA, 655 bp, Homo sapiens
  misc_feature: GYAE6OF01ECEMD.39.31.C09.1.454.CMB.1.raw
  modified_base (319)..(319): a, c, t, g, unknown or other
  misc_feature (319)..(319): n is a, c, g, or t
  modified_base (415)..(415): a, c, t, g, unknown or other
  misc_feature (415)..(415): n is a, c, g, or t
  modified_base (566)..(566): a, c, t, g, unknown or other
  misc_feature (566)..(566): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcggtgatcgacccagtcctccagacctccctggctgtgtctcgtgggcgaggacgggccaccatacaactgacaagtccacgccagtagttgttttacacgaggtaccaaacaataagtaatttacttcgtacgttaggtaccagcaagaaccaggacaggccttactaattcgctactatttcggnggctacgtaccgtaccgggaccggtccgggtccctgaccgtactcgacggcgacgcggtggtctagagacagtcttcacttccactacactacgancctacgccgtacgcgtagtcgtaaggaacgtgttacggaggttacgttaagttttacttaccgttaggtcctaaggctttaagttaactttaggtacttcgtaccttacggtaacgggtttcggtttacggggaacccgggacggtaacgnggtacgaagtacccgtaaggtaaaccgtaaggtcgggtaggcgaccgtagtacccgtagtttactcgttacctttagcccgtttacccc

SEQ ID NO: 3755 - DNA, 749 bp, Homo sapiens
  misc_feature: GYAE6OF01DJFUJ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagactccctggctgtgtctcgtgggcgagagggccaccatcaactgacaacgtccagccagacgttgtttaacacgacggtaccaacaaataagtaattacttcgtcgttaggtaaccagacacgaaacaggacagacctacctaagttcgactctatttacgtggactagtccgtacccgggaggtcccggggtcctagaccgtattcgagccggtcacggtcgggtctagacgaaccgtagttactttaccactacctaccaccgtactaccgaagtacccgacgtacccgtaggaccgtaacgggtaccttaaggaaacggttaagttcgggttaacggtaaccgtttaagggttttaacttaacgttcggtaaccgaggtaaccgttaaggttaacttttaaggttacggttaaccgttccctaacggtacgggtttaaccggtttcggggggaaccccgggtaacgtaaggtccgggtaacgggtaacgtaacgttaaaccggaaaacggtttaacgttcggggtacggtacctaccggtaccaacccgttagttacccgttacgtttaccgttacgtaccgtttacccccgg

SEQ ID NO: 3756 - DNA, 745 bp, Homo sapiens
  misc_feature: GYAE6OF01DHY2G.39.31.C09.1.454.CMB.1.raw
  modified_base (268)..(268): a, c, t, g, unknown or other
  misc_feature (268)..(268): n is a, c, g, or t
  modified_base (503)..(503): a, c, t, g, unknown or other
  misc_feature (503)..(503): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagactccctggctgtgtctcgtgggcgagacggccaccactcaaactgacaacgtccagaccagagttgttttacacacgtaccaaataataagtaattacttcgtcgttgtaccanacaacgaaaaccaggacacgtacctacctaagttcgactctaattttacgtcgggactacgtaccggtacccggggacggttccccgggtcccgtacggaccgtacgttcgacggtccgggacgacgggtccggggtactaggacggtaaccgtagttaactttacgtacctaccttaccgaaccctataccgtagtaccacgtacccgtaggccgtacggtaacgtagtaaggngttagggtcggtaactttaggttttactacgttaccgtagaacgtacgttaagtttaacgttagtaaggttacgttacccgttacggtaacggtttaccggtttaccggggggaccggtaaccgtaacggtcggtaacgggtaacgaaacgttaacccgtaaacggtaaacggttggaaccggtgtaccgtaacccgtaactacgttacccttcgttttacctaccgtaccgtttacccccg

SEQ ID NO: 3757 - DNA, 689 bp, Homo sapiens
  misc_feature: GYAE6OF01AJ3QG.39.31.C09.1.454.CMB.1.raw
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagtagttgtttacacaggtaccaaactaataagtaacttacttcgacttggtaccagacaagaaaccgaggacacgtcctacctaagttcgctntactttacgnggcagtaccgtaccgggtcgttcccgggtcctcggaccgtattcgacggccggtcgacgggtcggtctagagactagtactttcacctctacgacccatcgaacgtccgacgtccgtcggacacgggtctaaggagtagttcggtaggtcgtttaagtttactcgttagacgtagacgttaagttatttaacgtacgttacgtaccttacggttaacgtttaccgggtttaccggggacccgggtaccgtaacggtccgtaagggtactaaacgttaaccggaaaacggttccggtagggttaccggtcccgtaacggtaccctaccgtttaaacgttcccgtttaacgttccctttaaccgtccgtttaccccccgg

SEQ ID NO: 3758 - DNA, 633 bp, Homo sapiens
  misc_feature: GYAE6OF01EGSVK.39.31.C09.1.454.CMB.1.raw
  modified_base (118)..(118): a, c, t, g, unknown or other
  misc_feature (118)..(118): n is a, c, g, or t
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtncctacggggacatcgtgatgacccagtctccagactccctggctgtgtctctgggcgagagggccaccatcaactgcaagtccagccagagttgtttacacaggtccaaacaataagaattactcgcttggtaccagcaagaaaccaggacagcctctaagttgctctatttacgngggcagtccgtacccgggacggtcccggggtcctgaccgattcgacggcggcaggcggtctgagacagtatttcactccgtacacctatcgagcacgtcctgacgacggacgtagaagagttaggtggtacgttaagttttacttacgttgtactacgtactaagtttagtttaacgttaacggttacgttacccgtacgtaacggttaccggtttttacgggggacccggggtaacctaacgggtcgttacgggtaacgtactaaaccggaaaccggtacgttggtacggtcgtacgtaccaccgttacttcgtacggttccttcgacctttaccccg

SEQ ID NO: 3759 - DNA, 795 bp, Homo sapiens
  misc_feature: GYAE6OF01E3XZU.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctcgtggtgccgtacgggacatcgtgatcgacccagtcctccgagacctcccgtggctgtgtctcgtgggcgaggacgggccaccagtacaacgtgaccaacgtccacgccagtagttacgttttacacgtacgtaccaaactaataacgtaattacgttcgtacgttacggtaccacgacaaacggtaaaccgacggaaccacgtacccttacgttaacggttcgaccgttacttacgtttacggtcgggtacctaccgttaccccggtaacccgggggtacccgggttaccccggggttacccgtacggtaaccccgttagttaccggaccgggacgggtaccggacgggtcccggggtacgtacggtaacggaacttacggtaaccgttttaccctaccgttacctaccctacccgtaacgtaccgacgtaccgtacccgtccgtacggaccggtaggtaccgaaggtaacgtagtcggtaggtaccgttttatttacgtaccgtgtactaacggtagttaagtacgtttagtacgttccgtaccgttacgttaccgggttaccgggttccgggggaaccgtaacgtacggtacgtacggtaacgaaccgtaacggtaacgtgggtacgtaccggtcgacgttcctaacgtacgttcgtacgttacttccgtccgttacccg

SEQ ID NO: 3760 - DNA, 735 bp, Homo sapiens
  misc_feature: GYAE6OF01CVMA0.39.31.C09.1.454.CMB.1.raw
  modified_base (132)..(132): a, c, t, g, unknown or other
  misc_feature (132)..(132): n is a, c, g, or t
  modified_base (178)..(178): a, c, t, g, unknown or other
  misc_feature (178)..(178): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (570)..(570): a, c, t, g, unknown or other
  misc_feature (570)..(570): n is a, c, g, or t
  modified_base (637)..(637): a, c, t, g, unknown or other
  misc_feature (637)..(637): n is a, c, g, or t
  modified_base (721)..(721): a, c, t, g, unknown or other
  misc_feature (721)..(721): n is a, c, g, or t
tcagtcgcactagtcacgaccggtgctcgatttagacgtctcatcaaggaaggaaggggcagcaagatggtgttgcacgacccaggtcttcatttctctgttgctctggattctcgtggtgccgtacggganatcgtgatcgaccctagtcctcagcctcccgtggctgtcgtctcgngggagaggacgggcccaacctataccaacgtcgacgaacgtccgaacgccgtaaggtagtttacgttttaaccgaacgtaacggtaacccaaaagaaagttaaagtaactttaccgttcgtacgttacggtacccaggacaaacgaaccgaggactacggcccttaacgtaagttcnctacttagtttacgnggctacgtccgtacccgggaggtcccgggtctacggaccgtatccgaggccggacgacggtcgggtacaggacgtaactacggttactttacccacgttctaaccgtaaccaagttcccgaagtcccgaacgccgtcggaccgaaggtccgaaggtaagtaggttcggtaacggtagtttaagtttacggtagtccgganacggtagtaacgttataagtcgtaaccgtcgtacggtaacgtttccgggttaccgggccgggtaaancggtacgtcggaaagtaccccgtaagaaaccggtcgtaacgggtgccgtacgacccgttaacctacgttactacgtttaccctnttacccggttcccc

SEQ ID NO: 3761 - DNA, 753 bp, Homo sapiens
  misc_feature: GYAE6OF01DYD0Q.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgaggacgggcccaccataccaactcgacaagtccagccagtagttcgtttacacgaggtaccaaactaaataagtaattacttcgtcttaggtaaccagacaacgaaaccgaggaaccacgccttactaagttgctactacgtttacgtgggactactccggtaccccggggacggttcccggggtccctacggtaacccgtacgttacgacggtaccggcggacggtccggggttcaggaacgaactagttaacttttccaaccttcctaaccgaacctagtaccgaacgccgtaacgtccgtacgaacgtacgggtaccttaagggaaagttacgtaggtacggtacgttaaggtttttactacgttacgacgtaaggtacttaaggtttaattaacgttacggttaaccgtaccgttaacgtacgggtttaaccggttttccggggggaacccgggtaaaccgtagggtacgtaggtaacggtaaccgttaaaccgtaaacggtcgttagggtacgtcggtaccgtaccaccgttacttccgttaccgttacttacccgtccctttaccccg

SEQ ID NO: 3762 - DNA, 701 bp, Homo sapiens
  misc_feature: GYAE6OF01ERH0A.39.31.C09.1.454.CMB.1.raw
  modified_base (475)..(475): a, c, t, g, unknown or other
  misc_feature (475)..(475): n is a, c, g, or t
  modified_base (513)..(513): a, c, t, g, unknown or other
  misc_feature (513)..(513): n is a, c, g, or t
tcagtcgcactagtcacgaccggtgctcgatttagacgtctcatcaaggaaggaagggggcagcaagatggtgttgcagacccaggtcttcatttctctgttgctctggatctcgtggtgccgtacggggacatcgtgatcgacccagtctccacgacctccgtggctgtcgtctcgtgggcgaggcggcccacatacaactgaccacgtccagccagtagttagtttaacacgacggtaccaaacaataaagtaactttacgttcgtcgttacggaaccagaccaaacgaaaccgaggacacgtccttacgtaagttcgacttactagttacggcggactaccgtaccggtacccggggtaccggtcccgggtaccctacggaccgtagtcgcggccggacgtacgggcggtcagacgacgtagtacttcctactcctacctacactcgacgcgtaccgtcgtacgcgtacgtntaaggaacgttgtagtcgtacttattacttagtcgtanacgtactaatttagtaagttacgtaccgttacgtaacgttacgggtttaccgggttccggggaaccgggaacttacggtggtaaggtaaccgtaaacgttaaaccgaaacggtcggtttcgggactccggtaccgaacctaaccgtttgttacccggtttattcccgttcccgttccgttaacccccg

SEQ ID NO: 3763 - DNA, 529 bp, Homo sapiens
  misc_feature: GYAE6OF01AHSWJ.39.31.C09.1.454.CMB.1.raw
  modified_base (522)..(522): a, c, t, g, unknown or other
  misc_feature (522)..(522): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtcccggggtccctgaccgattcagcgacagcgggtctgagacagatttcacgtctcaccatcagcacgcctgcgaggctagaagatgtggactagtttacttacgttgtactagcgtagtattatagttacgtcctcgtagtacgttttcgggccggggtaccagcgtggacgagtacgaaacgtactgtcggctgaccactatctgtcttctnttccccg

SEQ ID NO: 3764 - DNA, 599 bp, Homo sapiens
  misc_feature: GYAE6OF01E4YYD.39.31.C09.1.454.CMB.1.raw
  modified_base (262)..(262): a, c, t, g, unknown or other
  misc_feature (262)..(262): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagaggccaccatcaactgcaagtccagccagagtgttttacacagtccaacaataagaattacttcgcttcgtaccagacagaaaccnggacagcctacctaagtgctctatttacgtggcactccgtacccgggtacggtcccgggtccctgacccgtattcagcggacgacggcggtctaggagactacgtatttaccactacgtaccaccgataccgagccacgtccctgacgaggctaacggatagtgtgtactagtttactactgtacgagacgtagttaacttagtagtacgtacctgtaacgttcggtttacgggacccggggaactaggtccgtagggatacgtaaaccgaaacggtacgtggtaccggtcgcgacctaacccgtacttcgtacgttcgttacctcccgttaccccg

SEQ ID NO: 3765 - DNA, 646 bp, Homo sapiens
  misc_feature: GYAE6OF01CIT4U.39.31.C09.1.454.CMB.1.raw
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (380)..(380): a, c, t, g, unknown or other
  misc_feature (380)..(380): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtcctccagacctccctggctgtgtctcgtgggcgaggacgggcccaccatcaactgacaacgtccagccagtagttcgttttacacgacggtaccaaacaataaagaattacttcgcttaggtaccagacaacgaaaccaggacacgtcctctaagtgctcatttacgnggacncgtccgtacccgggacgtcccggggtcctcgaccgtattcgacggcggcgacggccggtcngacgacagttacttcgactccacactatcagccagcctcgacgaggcgtagaaacgtgtacggtcggtaacttagttttactacgtgtacgtacgtacgtaagttactttaagtacggttacccgttcgttaacgtacgggtttacggttttaccgggggacccggggtaacacgggttacgagggtacgtaacgtaaccgtaaacggtcgttgggtcggtcctacgacctaaccttgttactccgtttcctcgttccgtaccccg

SEQ ID NO: 3766 - DNA, 779 bp, Homo sapiens
  misc_feature: GYAE6OF01BM9ZH.39.31.C09.1.454.CMB.1.raw
  modified_base (329)..(329): a, c, t, g, unknown or other
  misc_feature (329)..(329): n is a, c, g, or t
tcagtcgcactagtcacgaccggtgctcgatttagacgtctcatcaaggaaggaaggggcagcaagatggtgttgcagacccaggtcttcatttctctgttgctctggattctctggtgccgtacggggacatcgtgatcgacccagtctccagacctcccgtggctgtcgtctcgtgggccgaggacggccaccgatcaacgtgacaacgtccacgccagtagtttacgtttaccacgtacggtaccaaactaaagtaacgtaactttaccgttcgtacgttacggtaacccagacaaacggaaaccgagacacgtcctacgtagtcnctactagtttacgcggactaccgtaccggtacccggtcggtcccggttccacggtaccgtagttcgacggtcgacggacggtccgggtactaggaacgtacgtacgttaccgtttccaccgttctaccgtaacctcgtacgacgtaccgtccgccgtacggaccggtacggtacgtaaggtaaacgtcggttacgggtaccgtaacggttttaacgtttaccgtttaccgtaggtacccgtagttacggtttaagtttaagttaaacgtttacgggtacctttaaccggtcgtttaaaccggggtttcccgggtttaccgggggaacccgggtaacgttacggtacggttacggaaaccttaccgaaaaccggttacgggtacgtggtaacggtacctacggtaaccctacgtcggtttactacgtttcccttacggtcccttaccccgg

SEQ ID NO: 3767 - DNA, 618 bp, Homo sapiens
  misc_feature: GYAE6OF01C843H.39.31.C09.1.454.CMB.1.raw
  modified_base (323)..(323): a, c, t, g, unknown or other
  misc_feature (323)..(323): n is a, c, g, or t
  modified_base (384)..(384): a, c, t, g, unknown or other
  misc_feature (384)..(384): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagactccctggctgtgtctcgtgggcgaggacggccacatacaactgacaagtccagccagtagttcgtttaacacacggtaccaaacaaataaagtaacttacttcgtacttaggtaccagacaacgaaaccaggacacgtacctacctaagttcgctactaactttacgnggactacgtaccgtaacccggggacgtcccggggtaccctcggaccgtatcgacggccggnacggcggtcagacgacagtacttcactcacacatacagcacgctgacgacgcgtagaagtgtggtacgtactagtttactacgtgtacagtactaagttataagtacgtacgtactacgtacgttacggttacgggaccgggtaacacggtacgtaggaacgtacgtaacgtaaacgtcgtagggtacgtcgtacgactaacctgttacctacgtttccttcgtctttaccccg

SEQ ID NO: 3768 - DNA, 751 bp, Homo sapiens
  misc_feature: GYAE6OF01BVEI0.39.31.C09.1.454.CMB.1.raw
  modified_base (332)..(332): a, c, t, g, unknown or other
  misc_feature (332)..(332): n is a, c, g, or t
  modified_base (717)..(717): a, c, t, g, unknown or other
  misc_feature (717)..(717): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatgacccagtctccagacctcccgtggtctgtcgtctcgtgggcgagacgggccaccatcaactgcaagtccagccagagttgttttaaccacgacggtaccaaacgtaaataagtaactttacttcgtcgttacggtaccagacaacgaaaccaggacacgtcctaccgtaagttcgtcctacttaatttaccggngggtacctacgtcccgtacccggggtacggttcccggggtccctacgaccgtacgttcgacggtccggcgtagggtccggggttctaggaacgtacgtaagttacttttacccgaactttccgtaccctaaaccgtacgtaccaacggaccctaaccggtccgtacggaccgtacgggtactacggaaagtacgttgggtacggacgttttaaagttttacgtacgttacggtcgaacggttacgtaagttttaataaggtttaaccggttattcccgtacgtaacggttttacccggtttacgggggacccgggtactaacggtccgtaggaacgttactaaaccggaacgtacggttgggacgtcttaacgaccctaccggtnttacccgttattcccttaacgtcgtttacccccg

SEQ ID NO: 3769 - DNA, 918 bp, Homo sapiens
  misc_feature: GYAE6OF01AZ8GR.39.31.C09.1.454.CMB.1.raw
  modified_base (181)..(181): a, c, t, g, unknown or other
  misc_feature (181)..(181): n is a, c, g, or t
  modified_base (542)..(542): a, c, t, g, unknown or other
  misc_feature (542)..(542): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcggacccagtctccagacctccctggtctgtcgtctcgtgggngaggacgggccaccatcaactgacgaagtccgagccgagtacgttcgttttaaccgacgtacggtaccaaacgtaaacgttaaagtaaactttaccgttaccgtacgtttaccggttaaccgaacgtaccgaaacggaaaaccgaaggaaccacgtacccgttaccttaaggttcggtcttacttaagtttacggcggtacacgtacccgtacccggggacggttcccggggtccgtacgacgtacttccgacggtccgacgacgggcggggttctaaggacggtaacaacggttactttaccgtaaccttccaactacccagttacccgagtaaccgccgtcccgtagacgaaaccggtnttaacgggtaagttaccggttaggttaacgggttaacgtttttaagttttaaccgttacgtttacgtacccggtaagttaccgtaaaggttttaacgtttaaaccgtaaggggtttaaccttcccccgggtttaagtaaccgggggttttaccggggtttaacccggggggaacccgggttaacccgtaacgggttacggttaacggggttacccggaaacgttttaaaaaccccggaaaacggggtttccggttaaacggggttacccggggtttacccaacggtaacccccccgttaaccgtttttagggtaaacccccctttttagggtttaacccctttaacccgttttaacccccgggtttaccccccggg

SEQ ID NO: 3770 - DNA, 664 bp, Homo sapiens
  misc_feature: GYAE6OF01DYKGJ.39.31.C09.1.454.CMB.1.raw
  modified_base (360)..(360): a, c, t, g, unknown or other
  misc_feature (360)..(360): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaaactgacaagtccagccagagttgttttacacaggtccaaacaataagaattacttcgcttcggtaccagacaagaaaccaggaacagcctccgtaagttcgctctatttactggcactccgtaccgggacggttcccggggtccctaggaccgtagttcgacgtccggnacggcggggtctggacgacagtatttccaacttccncaccatcancgacnctagacacgggtactaggaagtacgtgtcggtactagttttagtacttcgtacgagtacgtagtttaacttagtacggttaacgtcccgttacgtaacgggtttaccggttttacgggggaccccgggggtaactacgggtacgtacgggaactaagtaacccggtaaaacggtaaccgttagggttacggtcttaccggaccctaacccgttaacgttcgttaccggttacctttcccgtacctttacccccg

SEQ ID NO: 3771 - DNA, 717 bp, Homo sapiens
  misc_feature: GYAE6OF01A4C3F.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgagagggccaaccatcaactgcaagtccagccagagttagtttacacgacggtaccaaacaataagtaacttacttcgacgttggtaccagacaacgaaaccaggacacgcctactaagtcgctactattacgcggcacgtccgtacccgggtacggtcccgggtccctgaccgtattccgacggcggcgacggtcggggtacctaggaagtacgtacgttacgtttccaaccttcctacctaaccgacgtcgaacgccgtaacgtccgtacggacgacgggtacgtaacggaaagtacgtcgggtaggtaaccgtttaagtttaacgttacgtacgtacaggtaacttaaggtttattaagttacgttacgttcccgttacggtacggtttacggtttccggggacccgggtaaccaggtaccgtaggtaaacgacgtaacccggtaaaagttaccggttaggttacgggaccgtttaccgaacccgtaacccgttacttccgtttaacgtcccgttttaacctccggtttacccccgg

SEQ ID NO: 3772 - DNA, 868 bp, Homo sapiens
  misc_feature: GYAE6OF01E2N2N.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaacgtccagccagtagttgtttacacgacggtaccaaacaataagtaattacttcgcgttacggtaccagacgaacgaaaccgaggacacgtcctacctaagtcgccctagtttacgtggacgtactccggtacccggggacggtcccggggtacccctcggtacccgtataccgacggcggccggacgggtccgggttacgtaggaacgaacgtaggttacttttaccaccgttacctaccaacccgtaactaccgaacggccctaacggtcccgtacggaccggtaaccggtacgttaaggaaaggttagtacggggtttacggtacgtttaacggttttaacgtttacgttcggttaaccaagggtacgttaaggtttaaacgtttaagtttaaccgggttaacgttacccctttaacgggttaacggtttaaccccgggggtttttaccggggggaacccggggggttaaaccctaacggggttaccggttaacggggtaacggttaaaccgtaaaacccggtaaaaaccgggtttaaaccggttcggggtaacccgggttaccggttacccggtaacccccgtaaacccgttaacccgtttacggttttacccggtttaaccccttttaccgggttaccccttttccccccgggtttaaccccccg

SEQ ID NO: 3773 - DNA, 719 bp, Homo sapiens
  misc_feature: GYAE6OF01A1FB8.39.31.C09.1.454.CMB.1.raw
  modified_base (327)..(327): a, c, t, g, unknown or other
  misc_feature (327)..(327): n is a, c, g, or t
  modified_base (529)..(529): a, c, t, g, unknown or other
  misc_feature (529)..(529): n is a, c, g, or t
tcagtcgcactagtcacgaccggtgctcgatttagacgtctcatcaaggaaggaaggggcagcaagatggtgttgcagacccaggtcttcatttctcttgttgctctggatctctggtgcctacggggacatcgtgatgacccagtcctccagacctccctggctgtgtctcgtgggcgagacgggccaccatccaacgtgcaacgtccagccagtagttgttttaacacacggtccaaacaagtaagtaacttaccttcgacgttcggtaacctagacaacgaaccgaaggacacgacctactaagttcgctctaagtttaaccgngggtactacgttccgtaacccggggtcgtcccggggtccctcggaacccgtacgtccgacggccggccaacggtccggtacgttagaacggaactacggtacttttcccgacccttctccgaaccctacggttaccaaggcccgagtcccttaggacggacggtcaggtaaatagtgtacggtattaagttttctacggttntacgtaagcttaaagttacgttattaaggtcttacccgttatacgggttaacgtttccggggaccggtaacgacgtacggtagaacgtaccgttaaacccggtaacgggtaaccgttggttacgggtacccggttacgacccgtttaccgaggtttccttacggtttcccctaagttcccgttacccccg

SEQ ID NO: 3774 - DNA, 560 bp, Homo sapiens
  misc_feature: GYAE6OF01CU4FY.39.31.C09.1.454.CMB.1.raw
  modified_base (251)..(251): a, c, t, g, unknown or other
  misc_feature (251)..(251): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagaggccaccatcaaactgcaagtccagccagagtgttttacacaggtccaacaataagaattactcgctggtaccngacagaaccagacagcctctaagttgctcatttactggcatcgtacccggagtccgggtcctgacctagttcagcggcagcggtctgacgacagtatttcactctcaccgtatcagcagcctgcaggctgaacgtagtgtaggctagtttatacgtgtcagtctaagtattagtacgtagtcctacgtagtacgtttagggcccggggtacacggtcgtaggaagtactaacgaaaacggtaaacgttgtaggtccgtacgtacccgaaccctacgttacctacggttaccttcgtacgtttacccccg

SEQ ID NO: 3775 - DNA, 755 bp, Homo sapiens
  misc_feature: GYAE6OF01D5IJ2.39.31.C09.1.454.CMB.1.raw
tcagtcgcactagtcacgaccggtgctcgatttagacgtctcatcaaggaaggaaggggcagcaagatggtgttgcagacccaggtcttcatttctctgtgctctgatctctggtgccgtacgggacatcgtgatcgacccagtctccagtactcctggctgtgtctctggcgagaggccacatcgaactgacacgtccagccagtagttcgtttacacgaggtaccaaacaactaagaatttacgttcgcttacggtaccacgacaagaaaccgaggaccagtacctactaagttgctactagtttacgtggctacgtccgtaacccgggtcggtcccgggtaccttcggaaccgtacttacgaggccggacgtacggcgggttacgtacggaacgacgtaacgtactttaccgactacctcaacccagtcgaacgtccgaacgtccgtcgacgtacggtaacttaggaagttacgttacgggtacggttaacgtttaacgttttaagtttaccgttacgtaccggtacgttaaccggttaaagttttaacgttaaaccgttttagtaaacccgggttttaccttaacggttaaaccgtttcgggttttaccgggggaacccggggttaacgtaaccgggttacggtagggtaaaccggtacctaaaacgggtaaaccgtaacggttcgaacggtccgttaacgacctacggtaaccttggttaacctttcgttaccgtaccgtttacccccgg

SEQ ID NO: 3776 - DNA, 734 bp, Homo sapiens
  misc_feature: GYAE6OF01D7H2Q.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctcccgtggctgtgtctcgtgggcgaggacgggccacatcaactgacaagtccagccagtagttacgtttacacgaggtaccaaacaataaagtaatttacttcgtcgttaggtacagacaagaaaccaggacacgcctactaagtcgctctactttacgcggctacgtccggtacccggggtacggtcccggggtcctggaccgtattcgacggccggcgtacggtccgggtagtacggaacgacgtagttacttttaccgacttccgtaccaacctataccgacgaccgaaccggtccgtacggaccgtacgggtcgtaaggtaagtacgttagggtggtaccgtttaaggttttacttacggttacgtacgtaacgtacgttaaggtttaattaacgtaggttaccgttaccttacggtaacggttaccgggtttaccggggacccgggggtaacctacggtacggtaggaacgtaacgtaaaccggtaaaccggttaacggttcggtacggttccgtacgaacccgtaaccgttacgttaccgttaccgtttacccttccgtaccgtttcccccgg

SEQ ID NO: 3777 - DNA, 935 bp, Homo sapiens
  misc_feature: GYAE6OF01BD8PS.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctcgtggtgccgtacgggacatcgtgatgaccagtctccagtacctccctggctgtgtctcgtgggcgaggacggccacatacgaacgtgactaacgtccagcctaaggtacgtttacgtttaaccacgtaacggtaaccaaaactaaagttaaacgttaacgtttaccttacggtaccgtttaacgggtaacccaaggaaccgaaacggaaaaaccgaagggaacctaccggttacccttaacgttaaacggttccgtaccttacgttaacgttttacggcgggtaccttaccggtacccggtaaccccggggtaccggttccccggggtccctacggtaacccgtacgttaccgacggccggtacgacgggtccgggtacgtaggaacgtaccgtaagttacctttacccgaaccgttcctaacccgaacctacgtaaccgtaccggaccgtccgtacccgtaggtaaccgacgggtaccgttaagggaacgttaccggttaagggttaccggtaaacgttttaaacggtttttacgttaacccggttaacgttaccgtaacggttacgtttaacgttttaaacgtttaaccgtttaacggtaccgttaacccgtttagggttaaacccgggtttttaccggggtttaacccgggggaacccgggttaaaccgtagggtacccgggttaaggtaacccgttaaaacgtaaacccgggttaaaaacgtcgggttacggggtaccggtaaccggtaccgtaaccctaaccggttacccgtttacgttaaccgttttccgttaaacccgttcccgttaacccccgg

SEQ ID NO: 3778 - DNA, 894 bp, Homo sapiens
  misc_feature: GYAE6OF01BCPLF.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctcgtgggcgagagggccaccatcaactgacaagtccagccagtagttgttttacacgacggtaccaaacaaataagtaatttacttcgtacttaggtaccagcaagaaaccaggacacgccctaccttaagttcgctactagtttacgtcgggactacgtaccggtacccggggacggtcccggggtcccctaggacccgtagttaccgaggccgggacgacgggccggggttactaggaacgtaaccgtaaggtacttttcccaaccgttccctacctaaacccgacttaccgaacgacccgtaacggtccccggttaggacccggtaacgggtaccgttaacgggaaagggttacgttacggggttacgggttaaccgttttaaacggtttttaacgtttaaccggtttacggttacccgtaaaggttaaccggttaaaggttttaacgttttaaacggttaacgggtttaacccgttttaccccggttaaccggttaaacggggttttaacccggggttttttaaccgggggggaacccccgggggttaacccgtaacggggtacgggttaacgggtaaacggttaaaccggtaaacccggtaaaaacccgggtttaccggttagggttaccggggttaccgttaacccggaacccgttaaacccggttaccgtttacgtttaccggttttacccgtttccgttaccccgtttaacccccggg

SEQ ID NO: 3779 - DNA, 672 bp, Homo sapiens
  misc_feature: GYAE6OF01ATY70.39.31.C09.1.454.CMB.1.raw
  modified_base (307)..(307): a, c, t, g, unknown or other
  misc_feature (307)..(307): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagagtgttttacacaggtaccaacaataagaattacttacgcttggtaccagacaacgaaaccaggaacacgcctacctaagttcgactctaatttacgnggcacgtccgtacccgggacgttccggggtaccctgaccgtattcgaggtccgcgacggcggtctagagacgagtacttcactctaccgactatcagacacgtcctagcgaggctagaacgtagtgtacggtacttaacgtttattacgtacgtactaacgtgtaacgttacgtttattaacggttaccgttacccgttacgtaagggtttacccggttttacggggacccgggggtaacctacggtacggttacgggtaaacgtaccgtaacccggtaaaacggtaccgttagggtacggtccgttacggaccctaaccgttacttacggttaccgtttacctttaccgtaccttacccccggg

SEQ ID NO: 3780 - DNA, 631 bp, Homo sapiens
  misc_feature: GYAE6OF01A4DNW.39.31.C09.1.454.CMB.1.raw
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagagggccaccatcaactgcaagtccagccagagttgttttacacgaggtccaacaataagaattacttcgcttggtaccagcaagaaccaggacagcctcctaagtgctcatttacgnggcatccgtacccgggaggtcccgggtcccngaccgacttcgaggccggcgacggtcgggtctgagacagtacttcactctcaccntacagcacgccngacgagcgtagaagtagtgttaggtacttaagtttactacgttagtacgtacgacgtaagttattaagttagttaccgttacctacggtaacgttaccgggttttacgggacccggggtaaccgtaggtccgtaacgggtacgtaacgtaaccggtaaaacgtacggttagggtaccggtcgttacgacccgtaaccgtaccttacgttaccggttaccttccgtaccgtttacccccg

SEQ ID NO: 3781 - DNA, 670 bp, Homo sapiens
  misc_feature: GYAE6OF01DRVYP.39.31.C09.1.454.CMB.1.raw
  modified_base (513)..(513): a, c, t, g, unknown or other
  misc_feature (513)..(513): n is a, c, g, or t
  modified_base (639)..(639): a, c, t, g, unknown or other
  misc_feature (639)..(639): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtctccagactcctggctgtgtctcgtgggcgagacgggccaccatacaactgcagtccagccagagttcgtttacacaggtaccaacaataagtaacttacttcgcgttggtaccagacaacgaacaggacacgtcctaccgtaagttgccttacttatttacggtcggactacgtccggtacccggggtacggttccccggggtacctacggaccgtattcgacggccggacgacggcgggttctggaacgacgtaggttcttttaccgacttcctaaccgtacctactacgaacgtccagtcccagcgaccggtataggaacgtgttgggaggtacctttagtttacttacgtcgtacgtacggtnttaagttaaccttaggttactaccggtacccttaggtaacgttccggtttaccggggacgggtaacctaggtccgtaaggtagaaaccgtaccgaaaacggttcgtaggaccggtctacggacccngttacctcgttcctcttccgtcttacccccg

SEQ ID NO: 3782 - DNA, 752 bp, Homo sapiens
  misc_feature: GYAE6OF01DEZAF.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgccctggatctctggtgccgtacggggacatcgtgatgacccagtctccagactcccgtggctgtgtctcgtgggcgaggacgggcccaccatcaactgacaacgtccagccgagtagttcgttttacacgacggttacccaaactaaataagtaactttacgttcgtacgtttacggtaaccagacaaacgaaaccgaggaaccacgtaccctaccttaaggttcacttactacttttacgcgggacctacgttacccggtacccggggtacggttccccggggtccctaggacccgtattcgacggtccggacgtacgggtcggtactggaacgaacgtacgtactttccaccttacctaccaacctcgttacacggtacaccggtcctcgacgtacggtccgtaagaagtagttacggtacgttaacgttaagttttacgttacgtagtacgtacgacttaagtttattaacgttacgttacgttacccgtagttaaccggtttaccgggttaccggggaccgggtaacctagggttccggtaaggtaacgttaaccgaaacgtaaccggtacggttcggtagtccgtacgtaccctacgttacgttaccgttaccgttaccttacctacccgtttcccgtaaccccg

SEQ ID NO: 3783 - DNA, 722 bp, Homo sapiens
  misc_feature: GYAE6OF01AW2OZ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagacctccctggctgtgtctcgtgggcgagagggccaccatccaactgcaacgtccagccagtacgttgttttacactaggtaccaaacaataaagaatttacgtcgtacttcggtaccaagcaacgaaaccgaggaccaggccctacgtaagtcgctactatttacgcgggactacgtccgtaccgggacgttacccggggtcccacggtaccgtacttcggacgcgggaccagggtccggttacgtagaacggactacggtattttccgaacttctacccacctaactcgaacgtcgaacgccgtggaccgacggtaccgtaggaacgtagttacgggttcggtaagtttaacgttttaacgttacgtggtactaacggtactaaggtttaacttaaggtaacgttacttaccgttacgtacgttaccgggttttaccggggaaccggggttaacgaacggtccgggtaggaacgtaacgttaaaccgtaaaccggtaacggttcggttacgggcctacggaaccgtacccgttcgttacgttaccgtttcctaccgttacgtttacccccg

SEQ ID NO: 3784 - DNA, 832 bp, Homo sapiens
  misc_feature: GYAE6OF01CRTMO.39.31.C09.1.454.CMB.1.raw
  modified_base (172)..(172): a, c, t, g, unknown or other
  misc_feature (172)..(172): n is a, c, g, or t
  modified_base (182)..(182): a, c, t, g, unknown or other
  misc_feature (182)..(182): n is a, c, g, or t
  modified_base (204)..(204): a, c, t, g, unknown or other
  misc_feature (204)..(204): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcccgtacggggacagtcgtgatacgacccagtctccagacctcccgtggctgtntctcgtgggngaggacggccaccatacaactnacaacgtccagaccaggtagtttgttttaaccaacgtacggtaaccaaaactaaagtaaagtaacgtttacgtcgtacgttcggtaacccagtaccaaacgaaaccgacggtaacaccgtaccttaccgttaagtcgaccttacttaacttttaccggcgggtaacctccttacccgggtaccccggggtacgggttccccggggtacccctacggaccccggtatttaccgacgggccggacgtacggtcggtcgaggacgtaacgtcgtacgtttcctacctacgtaccaccgtatcccgacgaccgtcgccgggtacgacggtaggtccggtaagaaacgtcggtttacggtcggttaacccgttttaggtttaccttaacggtaccgtacggacgtaaaccggtttagtttaactttaacgggttaacgtttccccgttaacccgttaggttaacccgggttttacggggtttaccgggggaaacccccgggtttaacgagggtaccggttaacggggaacttacggtaaaacccgtaaacgggtccgttaagggtcggtacccctaggtacccctaaacgtcctttaaccgtcgtttaaccccgtcttaacccgttaccccgg

SEQ ID NO: 3785 - DNA, 757 bp, Homo sapiens
  misc_feature: GYAE6OF01BMCLA.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgcctacgggacatcgtcgatgacccagtctcagactccctggctgtgtctctgggcgaggacggccaccatcaactgcagtccagccagagttgtttacacacggtaccaaactaaataagtaacttacttcgtcgttacggtaccagtacgaacggaaaccagggtaacctacgtacctaccttaacgttcggcttactaacgtttacgtgggtaccacgttccgtaccgggtccggttacccggggtccctacggaaccgtacgttcgtaacggccggtacgacggccgggttactacgggaacgtaccggtaacttacgttaccgtaacctaccgttaccgaaccgtaactcgaaacgtccgtacgtaccctaggtaccgtacgggtacttaacggaacgttacgttacgggttcggtaacgttttaagggtttaaacccttggttaggtacccttaagggtaccttaaaggtttacttaaccggttacggttacgttccgtaacgttacgggtttaacccggttccggggacccgggtaactaaggtcccgttaggaaccgtactaaccggtaaaccgtggttacggtacggcgtactacccgaactctttacgtgttccctaacgtcgttaacccg

SEQ ID NO: 3786 - DNA, 847 bp, Homo sapiens
  misc_feature: GYAE6OF01CBOOW.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctcagacctcctggtctgtgtctcgtgggcgaggacggccaccatcaacgtcgacaacgtccaagccgaaggtacgtttcgttttaaccgacgtaacggtaaccaaaactaaaagttaaaggtaaactttaccgttacggtaccgtttaacgggtaacccaaggacaaacggaaaaccgaggaaccacggtaccctacttaaggtcgtacctacgttaacgtttaccgcgggaaccttacgtacccggtacccggggtacgttaccccgggggttccctacgtaaccggtacgttaccggacggacccgggtaaccgtacgggggtttacggtaccggtagggtaaaccgtacgtaaacggtttaacttttaccccggaacgtttacctaaaccccgtaaccgtaacttaccggaaacggccgtaaccgggtccccgtaagggcccgtaaggggttcccaaagggtaacggtttaacggtggtaaccggttacttaacgggttttacttacggtaccgtaactacggtaacgttactttaagttaacggtaacgtttaaccgtcccttacggttaacgtttacccggttacgggggggacccgttaaacgacggttacgtaggtaacgaaccctaacggtaaacgtcgtaggccgggactcggacctacgtaacttcgtagtaccttcgaccgtttcccg

SEQ ID NO: 3787 - DNA, 732 bp, Homo sapiens
  misc_feature: GYAE6OF01AUGEH.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctcccgtggctgtgtctcgtgggcgagacgggccaccactcaactgacaacgtccagaccaggtacgttgttttaacacgacggtaccaaacaaataagtaatttaccttcgtcttacggtaccagacaacgtaaaccaggtaacacgtccctaccgtaagttcgcttactaactttacgtcgggactacgtcccgtaacccggggtcgggtcccggggttccctacggtaccgtacttacgacgtccggacgcggtcgggtacgtggacgaactagtactttcaccttctaccaccagtcaacgtccacggtctaggctacggtcgtacgaaggtacgttagacggttaacttaagttttacctaggttccgtaacgtcgtaagttaagttatttacggtacggttacctccgtacggttaccggtttaaccgggtttccggggggaacccgggtaccgaacggttcgtagggaactaaccgttaacggaaaccggttaagtcgggtaacggtcccgacgttaacccgacgttaccgttacgttaccggttacctttaccgtaccctttacccccgg

SEQ ID NO: 3788 - DNA, 773 bp, Homo sapiens
  misc_feature: GYAE6OF01AWA6N.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccacatcaactgcaagtccagccagagttgtttacactaggtaccaaacaataagaattacttcgcttggaccagcaacgaaaccaggacagcctacctaaggttcgcctactatttacgtgggactacgtccgtacccggggtacggttcccggggtaccctacggacccgtacttcgacggtccggacgtacgggtccggggtactaggaaccgtaacgtaggtacttttacccgaccgttacctaaccctacccgaaacttccaacggtcccgtaacgtcccgttacggaccgtaacggggtaccttacgggaaaggtacgttacgggtacggttacgtttaaggttttaacttaacgttcggtaaccgtaacggtacttaagttaacgtttaacgttacggtaccgtttacctaccgttaacggttaccggttttacccggggacccgggggtaacctaacgggtcgtacggggtaaagtaaccgtaacccgaaaacgggtaccgttagggtacggttaccgtacggtaccctaaccgttaacgttacccgtttaacgtttacccgttaccgttacccgtttaccccgg

SEQ ID NO: 3789 - DNA, 730 bp, Homo sapiens
  misc_feature: GYAE6OF01B4WE3.39.31.C09.1.454.CMB.1.raw
  modified_base (293)..(293): a, c, t, g, unknown or other
  misc_feature (293)..(293): n is a, c, g, or t
  modified_base (411)..(411): a, c, t, g, unknown or other
  misc_feature (411)..(411): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagacgggccaccatcaactgacaagtccagccagagttgtttacacgacggtccaaacaataaagtaatttacttcgcttaggtacccagcaagaaaccaggacagcctacctaagtnctctatttacgtgggacagtccgtacccggggtagttcccggggtccctgaccgtattcgaggccggcgtaggccgggttctagacgtaacagtactttaccacttcctaccaacctnacgagaccacgtcctaggccgtagggtcctaaggaagttagtacgggtacggacttttaaggtttaacctttacgtcgtacgtacgtacgtttaagtttagtttaagttaacggttaccgttacccgttagtaaccgggttttacgggttttacccgggggaacccggggttacctaaccgggttacggtacgggaaaggttaacctaaaccgggtaaaaccggttacggttcgggttaacccgggttactaccggaaccccttaaccgtacgttttacccgttaccggttttccctttaaccgtccccgttttccccg

SEQ ID NO: 3790 - DNA, 788 bp, Homo sapiens
  misc_feature: GYAE6OF01B6OT4.39.31.C09.1.454.CMB.1.raw
  modified_base (129)..(129): a, c, t, g, unknown or other
  misc_feature (129)..(129): n is a, c, g, or t
  modified_base (133)..(133): a, c, t, g, unknown or other
  misc_feature (133)..(133): n is a, c, g, or t
  modified_base (135)..(135): a, c, t, g, unknown or other
  misc_feature (135)..(135): n is a, c, g, or t
  modified_base (141)..(141): a, c, t, g, unknown or other
  misc_feature (141)..(141): n is a, c, g, or t
tcagtcgcactagtcacgaccggtgctcgatttagacgtctcatcaaggaaggaaggggcagcaagatggtgttgcagacccaggtcttcatttctctgttgctctggactcctgtgcgacggtacggnatgntnacgacngtctacgacgtcctcgtgtctgtctcgtcggaggacgacggaccggacccactactaacctagcgaacgtaaccgccgacgtacgtaagttcgtttactaaccgaacgtaccgtaaactaaagtaaagttaaacgttaccgttctcggtaaccggttacgaaccgacgaacgaaacggaacgtaacgacgtacctacgttactagtctaccttagttcgtacggccacgttaccggtccgggtaccggcgggttcccggtaacacgggttaacctgtacggaccggtcgtacggacggttaccgggatacggtaactacgtaactttacccactacccgttacaaccggtaccacggtcggaacaccggtaccgtcgacggtacgtaacggtacgtaacgggtacgttaacggttcggttaacgttaagtttagttacgttcggtacgtaacgtacgtttaagttacggttaacgttaagttcccgttacggtaaccgttagggttaccgggtttaaccgggtaccggggaaccgttaacggacgttaccggaagtaacccgtaaaccggtaacggtaaacgtgggtaccgtacggtcgaccctaccgttagttaccgttactaccgtttcctccggaccctttccg

SEQ ID NO: 3791 - DNA, 793 bp, Homo sapiens
  misc_feature: GYAE6OF01BCEPF.39.31.C09.1.454.CMB.1.raw
  modified_base (328)..(328): a, c, t, g, unknown or other
  misc_feature (328)..(328): n is a, c, g, or t
  modified_base (423)..(423): a, c, t, g, unknown or other
  misc_feature (423)..(423): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctcgtgggcgagacgggccaaccatacaactgacaagtccagaccagtagttcgtttaacacgacggtaccaaacaataaagtaattacttacgtacgttacggtaaccaagacgaagaaaccaggaaccacgacctactaagttcgactactatttacgnggactacgtccgtacccgggtacgtcccgggtacctagacgtatcgagcgacgacggcggtctagagacagtattccactactacacgatacgancacgtccgtagaccgagtcgtagaacgtagtcggtacggtacgttaacgtttaacgttacgtacgtaccgtaagtaccgttaaagttaacgtttaacgttaacggttaaccgttacccgttaaacggttaaccggggttttaacccgggttttaaccggggggaaccccgggggtaaacctaaacgggtaccggttaaacgggggtaaaccttaaacccgttaaaaccgggtaaaaacccgggttaaacggtttacggggaaacccgggtttacccgtaaaccgggtaaccccgtaaacccgttaacgttttacccccggttaaggttttaaccccccgtttaagttaaaccccgttttaacccccccgg

SEQ ID NO: 3792 - DNA, 574 bp, Homo sapiens
  misc_feature: GYAE6OF01BGQMV.39.31.C09.1.454.CMB.1.raw
  modified_base (284)..(284): a, c, t, g, unknown or other
  misc_feature (284)..(284): n is a, c, g, or t
  modified_base (349)..(349): a, c, t, g, unknown or other
  misc_feature (349)..(349): n is a, c, g, or t
  modified_base (386)..(386): a, c, t, g, unknown or other
  misc_feature (386)..(386): n is a, c, g, or t
tcagtcgcactagtcacgaccggtgctcgatttagacgtctcatcaaggaaggaaggggcagcaagatggtgttgcaggacccaggtcttcatttctctgttgctctggatctctggtgccgtacgggacatcgtgatgacccagtctccagactccctggctgtgtctctgggcgagagggccaccatcaactgcaagtccagccagagtgttttacacaggtaccaaacaataagaattacttcgcttggtaccagcagaaaccaggacagcctcctaagtnctcatttactggcatcgtaacccgggagtccggggtccctgacccgattcagcggcagcgggtcngagacgagactttcatctcgaccatcagcagtccgtncaggctagacgtatgtgtctagtttattactgtcagtactagttattagtaacgtcgtacccttagtaacgttacggttttacgggacccggggtaccgaagtccgtaggaacgttactaccgtaaacgtacctaggtaggcccgtaggaccctacctatacttcttcccgttctaaccgtttccccg

SEQ ID NO: 3793 - DNA, 729 bp, Homo sapiens
  misc_feature: GYAE6OF01EKK20.39.31.C09.1.454.CMB.1.raw
  modified_base (324)..(324): a, c, t, g, unknown or other
  misc_feature (324)..(324): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccgtggctgtgtctcgtgggcgaggacggccaccagtcaacgtgacgaacgtccagccaaggtacgttcgttttaaccactacggtacccaaacaagtaaagtaatttacgttccgacttggtaaccagacaagaaaccaggacagcctactaagttgctctattacgnggctactccggtaccggtcggtcccgggtcctcgaccgtagttcgacggcggcaggtccggtactggaacgtacacggtctttcaccttcaccacactcgagcgacgtctagctagcgtagacgtagtggtacgtagttacgtttacgttacgttgtacgtacgtacgtaacgtttaagtttacgttaagttacccgttaccgttacggtaacggtttacggttttacccgggggaacccggggtaacgttaaccggtacggttacgggaacggttaaaccgtaaaccgtaaaaccggtaacgggtttacggttaccgggttacccgaccgggtaccccgttaaacgttacccgtttacccggtttaccgtttaaccgttttcccttaaccccggtttccccccg

SEQ ID NO: 3794 - DNA, 774 bp, Homo sapiens
  misc_feature: GYAE6OF01BQLCN.39.31.C09.1.454.CMB.1.raw
  modified_base (346)..(346): a, c, t, g, unknown or other
  misc_feature (346)..(346): n is a, c, g, or t
  modified_base (474)..(474): a, c, t, g, unknown or other
  misc_feature (474)..(474): n is a, c, g, or t
  modified_base (482)..(482): a, c, t, g, unknown or other
  misc_feature (482)..(482): n is a, c, g, or t
  modified_base (497)..(497): a, c, t, g, unknown or other
  misc_feature (497)..(497): n is a, c, g, or t
tcagtcgcactagtcacgaccggtgctcgatttagacgtctcatcaaggaaggaagggggcagcaagatggtgttgcagacccaggtcttcatttctctgttgctctggatctctggtgccgtacggggacatcgtgatcgacccagtctccagacctcccgtggctgtgtctcgtgggcgagacgggccacatacaactgacacgtccacgccagtagttgtttaccacgtacggtaccaaacaagttaaacgtaatttaccttcgtcgttacggtaccaagacctaacgaaaccgaagggaccacgtaccttacccgttaagttcgtcctacttattttaccgnggggtacctacgttccccggtaccggggtaccgggttccccggggtacccgtcgaccgtaccgttcgaccgggtccggacgacgggccgggtctcggaacgactacggttactttaccaccgttaccncctaaccncgtcacgcaccgtcngacgacgtcgtacgagtggtgtacgtacgtttaagtttgttaccgtgtacgtacgtacgttaatttactttagtacggtttacgtaccgttacggttaaccggtttccgggttttaaccggggaccccgggggttaactaacgggtcgttaacgggtaaacgtaaccggttaaaccgtaaaccgggtacgttacgggtaccgggtccctaccgaccgtttaacccgttcgttaccgtttaccctttaccttacccgttaccggtttaacccccccgg

SEQ ID NO: 3795 - DNA, 811 bp, Homo sapiens
  misc_feature: GYAE6OF01BFA5H.39.31.C09.1.454.CMB.1.raw
  modified_base (179)..(179): a, c, t, g, unknown or other
  misc_feature (179)..(179): n is a, c, g, or t
  modified_base (791)..(791): a, c, t, g, unknown or other
  misc_feature (791)..(791): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagacctccctggctgtgtctcgtgggcgagnggccacatcaactgcaagtccagccagagttgttttaacacgtaggtaccaaactaaataagtaattaccttcgtcgttggtaccagacaacgaaaaccaggaacacgacctaccttaagttgaccttctaattttacgtgggtacacgttaccgtacccgggtacgggtccccgggttccctacggtacccgtattcgaacggcggcacggcggggttactgaacggactaacgttactttacacctacctacccgaacctacttacgaacgtacgaaccggttcccgtacgcccgtaaggtcgtacggtaaacgttagttcggttaacgggtaccttttaaggttttaaccgtttaccggttacggttaccgtaaacggactttaaacggttttaattaaccggtttaacggtttaaccgtttccccgtttaaacggttaacggtttttaccgggttttacccgggggaacccgggggtaacccttaagggtcccgggtttaagggaaaccgttacggttaaaacccgtaaaccgggtaacgtttcggtaaccgggtccttaaccggtacccaaaccggttacctttacccgttaggtccccttttaccncccgggtttttaaccccccg

SEQ ID NO: 3796 - DNA, 1024 bp, Homo sapiens
  misc_feature: GYAE6OF01A2UO2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggagacatcgtgatcgacccagtctccacgacctcccgtggctgtcgttctcgtggggacgaggacgggcccaccactacaacgtcgacaacgtccaacgccaaggtacggtttagtttaaccaacggtaccggtaacctaaaacgtaaacttaaaaggtaaacttttaccgttaccgtacgtttacggtaaacccgtaggaacctaaaacggaaaaccgaacgggaacctaccgtacccgttaaccgttaaggtttacgtaccgtttacgttaacgttttaaccggcggggtaaccttaaccggttaccccggttaacccgggggtacccggttccccggggttaccccgtacggtaacccgtacgtttacccggacggtcggaccggacgggtccggtacgtacggaacggacgtaagtttaccgtttaccaccttacccgtacctaacctacgtaaccgaccggtaccgtacggtaccgttcggacgttacggtaacggtaacggtaaacggttaaggttcgggttaacgttaaccggttttaacggttttaaccgttaaaccgtttacggttaaacggttacgttaaaccgggtttaaagttttaaacgtttaaacggttttaaccggtttaaccggtttaaccccgtttaacgggtttaccgggtttaaaccgggggttttaccccgggggaaaccccgggggtacgttaaccggggttaacggttaacggggtaaaaccgttaaacggtaaaaaccccgggtaaacgggtttaacccgggttagggttaacccccgggttacgttaaaccccggtaacccggtttaaacccttacccgggttttaacccgttttacccggtttaacccgtttaacccccggttttaaccccccg

SEQ ID NO: 3797 - DNA, 889 bp, Homo sapiens
  misc_feature: GYAE6OF01A1Q4H.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccgaagtagttgttttacactacggtaccaaactaaataagtaatttacgttcgtctttacggaacctacggacaacgtaaaacccgaggaccgaacgtcccttaacctaaaggtttcgacttactaacgttttaccgtgggactacgttacccgtaaccccgggggaacggtttccccggggtccctaggaacccgttacgtttaccgaacggccgggtaccaacgggtccggggttactaggaacgtactaacgttacttttaccaacttccgtacccgtaaacctaacgttcccgaaacggtaccctaacgggtccccgttagggtacccgggtaccgttaagggtaaacgttacggttacgggtttacgggtaaccgtttaaagggtttttaaccgttttaccgtacgggttaccgtaacgtaccggttaagtttaaacgttttaacttaacgggttaacgtttaccccttaacgggttaaccggtttaacccgggttttttaccgggggaaccccgggggggtttaaaccaaccggggttaccggttacgggtaaacgtaaaccggtaaaccgtaaaaaccgggttaaccggttagggtacccgggttacgtaccggtaaccctacgttaaccgtttcgttaccgttacctttaacctacgtttccccgttaaccccg

SEQ ID NO: 3798 - DNA, 671 bp, Homo sapiens
  misc_feature: GYAE6OF01EWR8B.39.31.C09.1.454.CMB.1.raw
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (657)..(657): a, c, t, g, unknown or other
  misc_feature (657)..(657): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctcccgtggctgtgtctcgtgggcgaggaggccaccatacaactgacaagtccagccagagttcgttttaacacgtacggtaccaaaacgtaaataaacggtaatttaccgttcgtacgttacgggtaaccaagaccaaggaaaacccacgggaaccgaacgtcccttaccgttaaagttcgccttactacgtttacgcgggactacgtcccggtacccggggtacggttcccggggtacctcggaccgtagttcaggtccggcgacggtcgggtctggacactagactttcacgtctacaccntacgacncacgctgcaggctagaatcgtgcgtattagttactntacgnagtactattactagtacgtacgttctacggtacgttacggttacggggaccgggtaactacggtcggtaggtaaccggtagtaacccggttaacgtaccggttagggtccggtcttaacgggccaaacttcgttcctacggttacccgtttnccccgtttaccccg

SEQ ID NO: 3799 - DNA, 755 bp, Homo sapiens
  misc_feature: GYAE6OF01DTUPI.39.31.C09.1.454.CMB.1.raw
tcagtcgcactagtcacgaccggtgctcgatttagacgtctcatcaaggaaggaaggggcagcaagatggtgttgcagacccaggtcttcagtttctctgttgctctggatctctggtgcctacgggacatcgtgatgacccagtctcagactccctggctgtgtctcgtggcgagacggccacatcaactgcaagtccagccagtagtagtttacgactacggtaccaacgaaataagaatttacttcgacttggtaccagacgaacgaaaccaggacacgcctaccgtaagtcgtctaccttaagtttacgcgggactacgttccgtacccgggtacggttccggggtaccctacgtacccggtagttcgaaccggcggaccgtaaggtccgggggtacctcgggaacgtaaccgagttacgttttaccgaaccgtccttaacgacctaacgttacccgaggacctcgcccgtgccgtaacgggtaccttaacggaagttaacgtcggttacgggttactaacgttttaacgtacgttagtaccgtaacggtaccgtaagttacgttaattaacggttacgttaacccgttaacgtacgtttaacccgggttttacgggaccgggggttaaccgtaacggtaccggtaggtaaacggtacgtaaaccgtaaaacggttaccggtaggttacggaccgttaccggtaccgtaaccctagttcccgttagttccgttacgtaacccgtttccccg

SEQ ID NO: 3800 - DNA, 706 bp, Homo sapiens
  misc_feature: GYAE6OF01AVRLP.39.31.C09.1.454.CMB.1.raw
tcagtcgcactagtcacgaccggtgctcgatttagacgtctcatcaaggaaggaaggggcagcaagatggtgttgtagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgtcttggtaccagcaacgaaaccaggacacgccctaccttaagttcgcctataactttacgtggggacctagttcccgtacccggggacgttcccggggtccctggacccgtagttcagggccggtcgaggtccgggtcgtaggacgaacaaggtctttacgacttcctacctaacccgtatccgaacgccacgtcccgtagacgtacgggtcctaggaaacgtcgttacggtagggtaccttaaggtttttacttaacgttcggttacgtaacggtccgttaaaggtttaactttaacgttagttaaccgttcccgtaacgttaacgggttacccggttttacgggggaccccggggtaacctaaggtccggttaaggacgtacgtaacgtaaaacggtacgttggtacggtctacgaccgtaccctagtccgttagtacctttactcgttcccgtaccccg

SEQ ID NO: 3801 - DNA, 849 bp, Homo sapiens
  misc_feature: GYAE6OF01EVQSW.39.31.C09.1.454.CMB.1.raw
  modified_base (136)..(136): a, c, t, g, unknown or other
  misc_feature (136)..(136): n is a, c, g, or t
tcagtcgcactagtcacgaccggtgctcgatttagacgtctcatcaaggaaggaaggggcagcaagatggtgttgcagacccaggtcttcattttctctgttgctctggatctctggtgcctacggggacatcgtnatcgacccagtcctccagacctccctggctgtcgtctcgtgggcgagacggccacatcaactgcaacgtccagccagtagttacgtttacacgacggtaccaaataataagtaactttacttccgtacgttacggtaccagacaacgaaaccacggaccacgtccttacgttaagttcgtacctacttaactttacgtcgggtactacgtacccggtaccgggtaccggtcccggggtaccctaggtaccgtacttacgacggccggtcgtaacggtcgggtactaggaacgtacgtacggttacttttaccgaccttaccttaaccgaaccttacgtaccggaacgtacccggtaacgttcccgggtacggtaccgtacggggtactaaacgggtacggttacgtacggtttaacgggtacctttttaaacgggtttaaccttaccggtttcggaccgttaacggtaacgttaacggttttaacgtttaaggttaaacccggttcggtttaccctaaacggttaccggggttttaccgggtttaaccgggggtaccccggggttaactaacggggtaccggttacggtaaacgtacccggttaaaaccggtaaaacccggtaggttaccgggttaccggtcgtaacccgaacccttaaaccggttacgttacccgttacgtttaacccgtttcccgtacgtttaccccccgg

SEQ ID NO: 3802 - DNA, 869 bp, Homo sapiens
  misc_feature: GYAE6OF01AUTE2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagttgtttacacaggtaccaacaaataagaatttacttcgcttggtaccagcaacgaaacccaggtacacgaccctccttaaggttcaccttactaattttacgtggggacctacgtaccctacccgggggacggttaccccggggtcccctagggacccgtacgttaccgaacgggccggacgtacgggtccggggttacctaggggaacaccgtaacggttaacttttacccgacctttaccctacccgtaaacccaacgtttacccgaacgggtacccaaccggtccccggtttaggacccggtacggggaccgtttaaggaaaaccggttaggtttacggggtaccggtaacgttttaacgggtttttaaacctttacgttaccgggtacccgtaaagggtaccgttaaaagttttacgtttaacgtttaacgggttaccgtttacccgttaacgggttaaacgtttacccggggtttttacgggggaacccccggggggtaaacttaaccggggtaacggttacgggtaaaccgtaaaccgtttaaacccggaaaaaccggtttaacgggttcggtttaaccgggcccgttaacgaccccggttaaccgttaacgtcccgtttaccggtttactttacccaccgttttaaccccc

SEQ ID NO: 3803 - DNA, 772 bp, Homo sapiens
  misc_feature: GYAE6OF01AQ1BB.39.31.C09.1.454.CMB.1.raw
  modified_base (462)..(462): a, c, t, g, unknown or other
  misc_feature (462)..(462): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatacaactgcaagtccagccagtagttgttttacacacggtaccaacgaaataagaattacttcgcgttggaccagacaagaaaccgaggacacgcctacttaagtcgctacagtttacgtcgggctacgtcgtacccgggaggttcccggggtacctcggaccgtattcgaacggcgggtacacgggtcggggttactaggacgtacgagttactttcccgacttcctaccgtaaccattacgacgacacgccgtagcgtaggtctaggaacgngttacggtggtacctttaaggtttacttacgttacgtaacgtaacgtcgtaaagttacgtttaacgttaacggttaccgtacccgttacgtaacgggttttaaccgggtttttaccgggggaaaccccgggggttaaccgtaacgggtccggttaaacggggtaaggtaaaccgttaaaacccggtaaacgggtttaaacccggttagggtaacccggggttcctaccgggttaaccccctaacccgttacgtttaccccggttttaacgtttacccgttttaacccgttcccggttttaacccccccgg

SEQ ID NO: 3804 - DNA, 715 bp, Homo sapiens
  misc_feature: GYAE6OF01ER8MN.39.31.C09.1.454.CMB.1.raw
  modified_base (312)..(312): a, c, t, g, unknown or other
  misc_feature (312)..(312): n is a, c, g, or t
  modified_base (371)..(371): a, c, t, g, unknown or other
  misc_feature (371)..(371): n is a, c, g, or t
tcagtcgcactagtcacgaccggtgctcgattttagacgtctcatcaaggaaggaaggggcagcaagatggtgttgcagacccaggtcttcatttctctgttgctctggattctctggtgccgtacggggacatcgtgatcgacccagtctccagacctccctggctgtgtctcgtgggcgagacgggccaccatacaactgacaacggtccagccagtagttgtttacacgtagtaccaaacaataagtaacttacttcgtcttacggtaccagacaacgaaaccgacggacacgccctaccttaagttcnctacttattacgtgggctagtccggtaccggggacggttcccgggtaccgtcgaccgtnttacgacgtcggcgacggtcggtacctagaacgacgtagttactttacctaccttcgtaccaaccgtatcgaacgtcgacggtccgtacggccgtaggccgtaacgaaagtacggtttggtacggttacgtttaagttttacgttacgttcggttactacggtacgttaagtttagtttaacgtagttacgttaccgtaccggttacgggtttaccgggtttaaccggggggacccgggtaacgtaccggtcggttaagggaaccgtactaaaaccgtacggtaaggttcggacggtctacgacttacgtaccttccgttactttccttctacccgttaccccg

SEQ ID NO: 3805 - DNA, 840 bp, Homo sapiens
  misc_feature: GYAE6OF01AZ4HN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctcgtggtcgccgtacgggacatcggtgatcgacccgagtcctaccgagtaccctcccgtcggtcttggttcgttccgtcggtggggacggaggacgggtacccaaccataccaactacggactaaccgtccgaacgcctaaggtagtttactttaaccacgtaccggtaaccaaactaaactaaagttaactttaccgtcgtacgttacggtaaccagaccgaaacgaaaccgaggaaccacgtaccttaacgttagttcgtaccttacgttacgtttacggcggtacctacggttacccggtacccgggggtaccgggttccccggggtaccctacgggtaaccgtacgttacgaccgggccggcggaccgggtcggtacgtaggaacgtacgtacttaccgtttaccaccttcctaacccaacgtacgaccgtacgccgtaccgtccgagtacgggtacgtcgtaaggtaacggtcggttacgttacggttaatttacgttttacgtacggtcgaccgttacggtacgtttaagttttacgttaaggtaacgttcccgttaacgttggtaacccggggtttcggggttaccggggaaccggtagaacggttacggaaggtaccgttaaacgtaaaccggaacgggttaccgtaggtaccggtccttaaccggactttaaacccggtctttacggtcccctttactttacccgtcccgttaacccccg

SEQ ID NO: 3806 - DNA, 717 bp, Homo sapiens
  misc_feature: GYAE6OF01AQ4RH.39.31.C09.1.454.CMB.1.raw
  modified_base (322)..(322): a, c, t, g, unknown or other
  misc_feature (322)..(322): n is a, c, g, or t
  modified_base (359)..(359): a, c, t, g, unknown or other
  misc_feature (359)..(359): n is a, c, g, or t
  modified_base (436)..(436): a, c, t, g, unknown or other
  misc_feature (436)..(436): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggagggcccaccataccaactgacaagtccagccagagttgttttacacgacggtaccaaacaataagaatttaccgttcgtcgttacggtaaccagcaacgaaaccaggacagccctaccgtaagtcgtctactactttacgngggacagtccgtacccggggacggtcccggggtcccncgaccgattcgacgcggcgacggtcgggtctaggagacgaaggtactttacgactcctaccacctataccacgaccncggacccgtcggacacggtactaggaagtacgtaggttgggtacctttaagttttaacgttaccgttgaccgtaagtaccgttaagtttaacgttacgttaaggttacctaccgtacgggttaagttacccggttttacgggggacccgggggttaaccaccgggttacgtagggtaacgttaacgtaaccggaaaacgttaccggtagggttacggtcccgtacgtaccctaaccgttactacccgtttaggttccctttaacgtccgtttaacccccgg

SEQ ID NO: 3807 - DNA, 660 bp, Homo sapiens
  misc_feature: GYAE6OF01DB2E0.39.31.C09.1.454.CMB.1.raw
  modified_base (325)..(325): a, c, t, g, unknown or other
  misc_feature (325)..(325): n is a, c, g, or t
  modified_base (366)..(366): a, c, t, g, unknown or other
  misc_feature (366)..(366): n is a, c, g, or t
  modified_base (449)..(449): a, c, t, g, unknown or other
  misc_feature (449)..(449): n is a, c, g, or t
tcagtcgcactagtcacgaccggtgctcgatttagacgtctcatcaaggaaggaaggggcagcaagatcggtgttgcagacccaggtcttcatttctctgttgctctggatctctggtgcctacgggacatcgtgatgacccagtctccagactccctggctgtgtctcgtgggcgagacgggccaccatcaactgacaacgtccagccagtagttgtttacactacggaccaacaaataagaacttacttcgtacgttacggtacctagacgaacgaaaccgacggtacaacgtcctacctaagttcgctacgtaactttacgnggcacgtccgtacccggacgggtcccggtcctcgaaccgtntacgacgtcggcctaggtccgttcgtgaacgacacgtactttacgactcgtacacctatcacgcacgctcgcgagtcagaagnttaggtggtacttagttacttacgtcgtaacgtagacgtagttatttaagtacgttacgtacccgtacgtaacggtttacggtttacccgggggaccgggttaaacgtacgttaggacggtaacgacgttaaaccgaaaccggtacgtacggtcgtaccgtccgaaccgtaccgtactttacgtacgtttccctaacgttcccgtaccccg

SEQ ID NO: 3808 - DNA, 863 bp, Homo sapiens
  misc_feature: GYAE6OF01AHDIL.39.31.C09.1.454.CMB.1.raw
  modified_base (814)..(814): a, c, t, g, unknown or other
  misc_feature (814)..(814): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggacgggtccaccagtacaacgtcgacaacgtccacgccagtagttgtttacacgtacggtaccaaactaaagtaacgtaactttacttacgtaccgtttacggttaacccgaaggaccgaaacgaaaacccgaacggaaccgacggtaccctaccgttaaacggttccggtaccttaccgttaacgttttaaccggtcggggtacctaaccggttaccccggttaaccccggggggtacgggttacccccgggggttaccccgttacgggtaaccccggttacgttaccggtacggtccgggtacggacgggtaccggggttacgtacgggaacggtaaccgtaggttacctttaccgtaccgttaccgttaccctaaacccgtaacgtaccggaccgtaccgtaccggtaacccttaacgggaaccgggtacgtaagggtaaacgttaggttacgggtacggttaacccgtttaaggtttttaaacctacgtttaggtaccgtacgtaagttaacgtttaattaacggttaacgttaccttccgtacgtacggtttacgggtttaaccggggggaccgttaacgtacgggtacgtaacggtacgacgtaaaaccgaaccgtagtacggtacgngttaccgacctaccagttccttacggttactaccgtcttcccgtacccg

SEQ ID NO: 3809 - DNA, 722 bp, Homo sapiens
  misc_feature: GYAE6OF01DGFKP.39.31.C09.1.454.CMB.1.raw
tcagtcgcactagtcacgaccggtgctcgatttagacgtctcatcaaggaaggaaggggcagcaagatgatgttgcagacccaggtcttctatttctctgttgctctggatctcgtggtcgaccgtacggggacagtcgtgatcgacccagtcctaccacgacctcccgtggtctggtcgtcgtcggtggggacggaggacgggacccaacctactacaacgtcgaccaacgtccacgacgagtagttatttacacgtacgtacaacaataagtacttacgtacgtacgttacgaccagacgaacgaaaccgaggaccaccgtcctaacgttaagtcgacttacgttacgtttacggcggactacgtaccggacccgggtacggtcccggtaccgtacgtaccgtatacggacggccgcgtacggcggtacgagagacgtacgtacttaccactacacaccgtatacgacgacgtacgtaccagacgtacgtacgtaagacgtagtggtacgtattaagtttgtaaccgtgtactacgttagtaaatttacgttaacgttacgtacgttacctaacgggttacgtttaaccggttacccgggggaaccgtagacggtacggtaaggactaaacgtaaaccgggtaaactacggggttcgtccggtccgaaaccgtaaccctacggttacttccggttaactttccccgagtttacccccccg

SEQ ID NO: 3810 - DNA, 762 bp, Homo sapiens
  misc_feature: GYAE6OF01CG6O5.39.31.C09.1.454.CMB.1.raw
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctgctgtcgtctcgtgggcgagacggccaccatcaactgacaacgtccagccagtagttgttttacactaggtaccaaacgaataagtaattacttcgcttacggtaccagacaagaaaccgaggacacgtcctactaacgtnctacgatttcgnggctacgtccgtacccggggtagtcccggggtacctcggaccgtagttcgacggcggaccgaggtccggggtctacgggacgtaaccaacgttacgtttaccaaccgtttacctaacccgtaacctaacttacccggacgtaccgtaacggtaccctcgggacgaccgggtagtaggaaacgttaggtcggtacggttacgtttagttttaaccgttacgtcggaacctaggttaactaagggtttaactttacgttaagggttacccttaccgtttacggtaacgggtttttacccggtttccggggaaacccgggggttacctaacgggtggtaaacggtccgtaaggttaaaccccgggaaacgtacgtttacggggacgttcccggattaaacccccgaccgttacgtaccttaccggtttacccttcgttaacccgtttccccg

SEQ ID NO: 3811 - DNA, 702 bp, Homo sapiens
  misc_feature: GYAE6OF01BHDAP.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctggcgagaggccaccatcaactgcaagtccagccagagttgtttacactaggtccaactaataagtaattacttcgcttggtaccagcaagaaaccaggacagcctacctaagttcgctctatttacgngggctacgtaccgtacccggggacggtcccgggtccctacggaccgtattcgacggccggacgcggccgggtctaggacgactacggtactttaccaccgttcctacgaaccctatccgaacgccgtaacgtccgtgaccgtacgggactacggaaagttggtacggttacgggaacgtttacgttttacgttaccgttggtactacgtcctaaagtttagtttaagttacggttaaccgttcccttacgtaacgggtttaccggttttacgggggaccccggggtaaccaacggttcggtaaggccgtaaacgtaaaccggtaaaccggtcgttagggtaccggccgttacgacccgtacccgtattccgttaccgtttccgttcgacccgttttacccccgg

SEQ ID NO: 3812 - DNA, 709 bp, Homo sapiens
  misc_feature: GYAE6OF01C1WLK.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcccgtacggggactatcgtgatcgaccctagtcctccagtacctcccgtggctgtgtctcgtgggacgaggacgggccaccatacaactgacaacgtccagccagtagttgtttacacgacgtaccaaataaataaagtaacttacgttcgtacgttacggtaccagaccaaacgaaaccgaaggaaccaccgtacccttacgtaacgttcgccttacttactttacggcggtactacgtaccggtacccggggtacggtcccggggttccctacggtaccgtacttcgacggaccggcgtacggccgggtctacggagactacgtactttaccacctctaccactactcaacgcacgtcacgacgtagacgtagtaagtagttacggtagtacgttatttacgtacgtgtacgagtactagttaattacttacggtactccgtacgtacgggttacgttaccgggggaccggtaacgtaggtacggtagaacgtaacgtaacgaaaccgtacgtgggtacggtaccgtaccgtaaccgttaaccgtaccgtttacgttaccgtttacccttacgttacccgttacccccg

SEQ ID NO: 3813 - DNA, 788 bp, Homo sapiens
  misc_feature: GYAE6OF01BYVTZ.39.31.C09.1.454.CMB.1.raw
  modified_base (520)..(520): a, c, t, g, unknown or other
  misc_feature (520)..(520): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactcccgtggctgtgtctcgtgggcgaggacgggccaccatacaactgcaagtccagccagagttagtttacacgacggtaccaaactaaataaagtaattacgttcgtcgttaggtaaccagaccaagaaaccgaggaaccacgtacctaccgttaagttcgacttactaacgtttacgtcgggactacgttaccggtaccccggggtacgggtccccggggttccctacggtacccgtacgttaccgacgggccggtcgacggtcggggtcgtaggacgtaacgagttacgtttacaacgttccgtacctaaccgtactaccgacgtaccaccggtcctacggacgacggtacgtagaaacgggtnttcgggtaggttacctaaggtttttaccttacgttacgtaccgtaggtactttaacgtttattttaaggtacggttaaccttaccgttaacggtaacggttttacccggggtttcccgggggaaacccggggtaacctacggtacggtaacgggtaactacccggtaaaccgtaaaacgggtaaccgttggggtaacggtcccgtaacggtaccctaaaacccggttcgtttacttaccggtttacctttaccgttcccgttaccccg

SEQ ID NO: 3814 - DNA, 917 bp, Homo sapiens
  misc_feature: GYAE6OF01B99G8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctcccgtggctgtgtctcgtgggcgaggacgggccacatcaactgacaacgtccagccgagtagttcgtttaacacgtacggtaccaaacaaagtaagtaatttaccgtcgtaccttaggtaaccagacaacgaaaccgacggaacacgcctaccgtaagttcgctacgtacgttacgtcgggacctacgtacccgggtacccggggtacgggttcccgggtacccgtacggtaaccggtacttccggaacggccgggtaaccgtaggggtacccggggttacgtaacggaacggtaactacggtttaaccttttcccgtaaacccttccggtaacccgtaccctaacgtcccgtaaccggtaccggtaaccgtcccgtacggacgttaaccgggtacgttaacgggtaaacggttacggtttaccgggtacgttaccggttttaaacgttttacgttacccggtacggttaaccgtaacggttaccgttaaaggttttaacttaaaccggttacggttaacccgttaccgttaacccgggttaaccgggttttaacccgggggttttacccgggggaaacccggggttaacctaacggggttacccgggtaacgggttaaaccggttaaacccgtaaaaccgggtaaaaccggttaaccggttgggtaaacccggtccgttacccggtaacccttaaacccggtttcgtttaacccggtttacgtttccccggtttaacccgttaccgggtttacccccccg

SEQ ID NO: 3815 - DNA, 824 bp, Homo sapiens
  misc_feature: GYAE6OF01A8AZM.39.31.C09.1.454.CMB.1.raw
  modified_base (340)..(340): a, c, t, g, unknown or other
  misc_feature (340)..(340): n is a, c, g, or t
  modified_base (764)..(764): a, c, t, g, unknown or other
  misc_feature (764)..(764): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctcccgtggctgtcgtctcgtgggcgaggacgggcccaccatccaactcgacaacgtccagccgaagtagttcgttttacacgtacggtaccaaacaataagtaacttacttacgtcttacggtaccagacaacgaaaccaggacacgtaccttacgtaagttcgaccttacttaacgtttacgngggacctaacgttaccccggtacccggggtaccgggttcccggggtaccctacggaccgtagttacgacggccgggcgtacgggtccgggtatcggaacgtactaacggttactttcccgaacttccgtaccctaaccacttacgaacgtaccgtaccgttaccgcggtaaccgtacgggtaccttaagggtaacgtaacggtttgggtaccgggttaacttttaaacggtttttaacgtacggtttacggtaaccgttaggtaacttaggtttaacttttaacggtaacggtttaccggttacccttacggttaaccgggttttacccggggttttaacggggggaacccgggtaaccgtaacgggttccggaaggtaaccggaaacttaaaccggaaacggttacggttggtaccgggtacnccgggttaaacccaccgttacgttacccgttacttaccgttccgtacccggtttaccccc

SEQ ID NO: 3816 - DNA, 695 bp, Homo sapiens
  misc_feature: GYAE6OF01BMTN5.39.31.C09.1.454.CMB.1.raw
  modified_base (297)..(297): a, c, t, g, unknown or other
  misc_feature (297)..(297): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagtgtttacacaggtaccaacaataagaattacttcgcttggtaccagacagaaaccaggacagcctactaagttcgctctatttacgngggactagtccgtacccgggtacggtcccggggtccctaggtacccgtattccgaggccggtacgaggtccgggtctaggacgacctaaggtactttacgacctctacaccctataccgacgccacgtacccgtcgacgacggtacgtagaaaggtagtcggtagggtaccttaaggttttaacttacgttacgtacgacgtacgtaacgtttagttaataaggtaccgttaccgtagtaaccggttacccggttttacggggaccccggggtaaccaaggtacggtacgggaacgtaacgtaaccggtaaaccggtaacgtagggttaccggccgttaccggtacccgtaacccgtaccgtttcgttaccgttcctttaccgcccgtttacccccgg

SEQ ID NO: 3817 - DNA, 681 bp, Homo sapiens
  misc_feature: GYAE6OF01B1OUN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctggcgagaggccacatcaactgcaagtccagccagagtgtttacacaggtccaacaataagaattacttcgtcttggtaccagacagaaaccaggacacgcctactaagttcgactctatttacgtcgggctactaccgtacccggggtaggttccccggggtccctacggacccgtacgttccgacggtccgggtacgagggtccggggtctagggaacgtaaccgtagtacgttttccgaccttcctacccaccatccaacggtaccaacgccgttagcgaggtacgtacggaagtagttggtacggtacttaagttttaattacttgtacagtactaagttacttaagttacgttaacgtcccgtacgtacggttacgttttaccgggacccggggtaacaagtccggtagggtaacgtacgtaaccgtaaacggtaacgttggtacggtcctacggtacccaacccgttacttacgttaccgttacctttaccgcgtttaaccccccg

SEQ ID NO: 3818 - DNA, 744 bp, Homo sapiens
  misc_feature: GYAE6OF01EQDE3.39.31.C09.1.454.CMB.1.raw
  modified_base (236)..(236): a, c, t, g, unknown or other
  misc_feature (236)..(236): n is a, c, g, or t
  modified_base (411)..(411): a, c, t, g, unknown or other
  misc_feature (411)..(411): n is a, c, g, or t
  modified_base (561)..(561): a, c, t, g, unknown or other
  misc_feature (561)..(561): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgagacgggccaccatacaacgtgactaagtccacgaccgagtacgttcgttttaaaacncgaggtaccaaacaaataaggtaactttacttccgtactttacggtaaccagtaccaaacggaaaccaggaaccaggtcccttacgtaaggttcgtacctactaacttttacggcggggtacctaacgttaccggtaccccggggtaggttccccgggttccctaggaacccgtnttacgacggccggacacggtcgggtctaggacgactagtactttaccactacgacctacactccgacgcctacgaccgtcgacgttacgaccgtagggtaacgtgtagggttacgtaacgttttaaggttttacgttacgtacggtacgnggtaccgtaagtttacgttaataaccggttacgttccgttaccgtagggttttaccggtttccggggaaccgggtaacgaacgggtcgtagggtaaccgtacgttaacaaaccgggttacgttgggtaccggtctaccggtaacctacgttactacgttacgtccctttaccgtgttcccccg

SEQ ID NO: 3819 - DNA, 833 bp, Homo sapiens
  misc_feature: GYAE6OF01CA11J.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctcgtggtcgcccgtacggggacagtcggtgatcggaccctagtcctaccagacctcccgtggcttggtcgtccgtcgtgggcgaggacgggccctaccgatcaatcggacaacgtccacgccaggtgttactttacacgtacgtaccaactaaataagtacttaccgtcgacttacggtaccacgtacaacgaaaccgacggactacgtacctaccgttaagtcgaccttacgtacgtttacggacggtactaccggttacccgggtaacccggggtcgggttccccggggttccctaggtaacccgttacggtaccgacgggccgtacggtacgggtccgggttaacgtcggaaacgtaccctaacggtttacccgtttacaccccgtttacaccctaaccacgttccgaacggtccaccggttcggaacgaccggtacggtacggttaacgaacggttagtcgggttaacggttacgtttaaaccggtttacgttaccgttacgaccgtaacggttatttaaaccggtttaattaaccggtttccgttaaccgttccggtaaaccggttttccgggtaaccggggtttacccggggaaccgggtaccgtacggttcgggaacgttacggtaaccgtaaaaggtacccggtagttcggtaccgtcgttacccgtaacctcgttaaccgttcttccgtttaactcccgttaacgttccccgg

SEQ ID NO: 3820 - DNA, 668 bp, Homo sapiens
  misc_feature: GYAE6OF01E4VND.39.31.C09.1.454.CMB.1.raw
  modified_base (300)..(300): a, c, t, g, unknown or other
  misc_feature (300)..(300): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgttttacacaggtaccaacaaataagaattacttcgtcttggtaccagcaagaaaccaggacacgcctcctaagtgctctatttacnggacatccgtacccggggcggtcccgggtccctgaccgattcgagccggcgaggcgggtctgacgacagtatttcactctacaccatacncgcacgccncgcgaggctagaagagttggtggacttagtttattacgtcgtacgtacgactaagttattacgttaagttacgttaccgtacgtacggttaccggttttacgggggaccccggggtaaccgtaacggtaccggttagggtaaacggtaacgtaaacccgtaaaaccgggtaaccgttacggggttacgggtccgttccgggtaaccctaaacccggttaaccgttacgtttaccggtttccctttaccgttaacccgttttccccccgg

SEQ ID NO: 3821 - DNA, 829 bp, Homo sapiens
  misc_feature: GYAE6OF01ALM42.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtcctccagacctccctggcgtgtcgtcgtcgtgggcgaggacgggccaccatacaactgacgaacgtccacgaccagtagttgttttaccactacggtaccaaacaataagtaactttacgttcgtaccgttcggtaaccagaccaagaaaacccgacggacgtaacgccttaaccgtaaggttcgtacttactaacgttttacgtcgggacctcgttacccggttacccggggtacgggtccccgggtcccgtacgaccgtacttcggacggtcggcgacggtcggtcgtacgagactacgtattaccactcctaccacctagtccgacgccgtaccggtccgtagggacccggaggtaccgtaaggtaaacgtggttaacgggttacggttaccgttttaggttttaaccttaccgggtttaggtacccgtaagggtaacgttaacgttttaacggtacgtttaacggttaccgttaacccggtttaccgttaacggggtttttaccgggggtttacccggggaaccggggttaacctaaccggggtcggttaaccggtaagtaaacccgtaaaaccggttaacgtaaccgggtttcggtaaccggttaccgacccggtacccgttaacgtaccccgtttaggttacccgtttcccgtttaacccgtccggtttaacccccg

SEQ ID NO: 3822 - DNA, 711 bp, Homo sapiens
  misc_feature: GYAE6OF01AEZ81.39.31.C09.1.454.CMB.1.raw
  modified_base (325)..(325): a, c, t, g, unknown or other
  misc_feature (325)..(325): n is a, c, g, or t
  modified_base (441)..(441): a, c, t, g, unknown or other
  misc_feature (441)..(441): n is a, c, g, or t
  modified_base (464)..(464): a, c, t, g, unknown or other
  misc_feature (464)..(464): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtcctccagacctccctggctgtgtctcgtggggcgaggacgggacccaccatacaactgacaagtcccagccagagttgtttacacaggtaccaacaaataagtaattacttcgacttaggaccagacaacgaaaccacggtacaccgtaccctacctaagttcgtcctactaattttacgngggacacgtacccgtaaccccggggcggttcccggggtccctggacccgtattacgacggcggccgacggtcggggtactggaacgacgacgtacttttacactcctaccaacctnaccgacgaccgtccggttaccgnggaccgacggtacgttaacggaagttacgtggtacgggtaccgtttaagttttaacctttaggttactacgtacgtacgtaagtttactttaagtacgttacgttcaccttagggtttaccgggtttaccggggaacccgggtaaccgtaaggcggttaacggacgtaaaccgtaacgtaaaaccggtcgtaggttaccgcgtaaccgactaccgttattcgtaccgtttcttaccgtccttccccg

SEQ ID NO: 3823 - DNA, 717 bp, Homo sapiens
  misc_feature: GYAE6OF01CB4VS.39.31.C09.1.454.CMB.1.raw
  modified_base (483)..(483): a, c, t, g, unknown or other
  misc_feature (483)..(483): n is a, c, g, or t
  modified_base (553)..(553): a, c, t, g, unknown or other
  misc_feature (553)..(553): n is a, c, g, or t
  modified_base (626)..(626): a, c, t, g, unknown or other
  misc_feature (626)..(626): n is a, c, g, or t
  modified_base (673)..(673): a, c, t, g, unknown or other
  misc_feature (673)..(673): n is a, c, g, or t
  modified_base (692)..(692): a, c, t, g, unknown or other
  misc_feature (692)..(692): n is a, c, g, or t
tcagtcgcactagtcacgaccggtgctcgatttagacgtctcatcaaggaaggaaggggcagcaagatggtgttgcagacccaggtcttctatttctctgttgctctggatctcgtggtcgccggtacgggactagtcgtgactcgacccacgtcctccacgtacctcccgtgtcgttgtcgtcgtcggtgggacgacggtaccggacccaaccgactacctaacgcgaccgtaacgtccacgaccgtaagttagtttacgtttacacgtaaccgtaaccaaacgtaactaagtacttactcgtacgtacgtaccacgacaacgaaacgacggacactaccgtactagtcgtactacttacgttagcgtactaccgtaccggtacccggtaccggttcccggtccctacgaccgtacgtcgacggccggacgtcgggtacgtgacgaacgacgtattcgttccactacctaccgactacgacncacgacgtccgaggtaccgacgtacgtaacggagtcgttagggtaccgtttaattagttaccgtacggtnaaccgttagtaccgttaaattgttacgtaccgtaccgttgtaacggtttcggtcggggttaccggaacgtaanacggtggtaccgaacgccgtaaactaggaccgttggaccttccgganccccgtttaagtccctttnttacccgtcttacgtcccccgtacc

SEQ ID NO: 3824 - DNA, 751 bp, Homo sapiens
  misc_feature: GYAE6OF01CRYY0.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgaccctagtctccagaccttccctggctgtgtctcgtgggcgaggacggccaccatcaactgacacgtccagccagagttgtttacacgtacgtaccaaacaataagtaacttacgttcgcttaggtaccagacaagaaaccgaggtacacgaccttcgtaaagttcgactcttaactttacgtacgggctacgtcccggtaacccggggcgttcccggggtacctcggaaccctagttccgaggtccggccgaaggtccggttcgagacgtacaggttactttcgactctaccacctatcagtcacgtcgtacgacgacgtacgtaggaacgtacgttaggtacgttaaccgttagtttttacgtaacggtttccgtaagtaccgttagttaaacgtttagttaacgtttacgttaacccgtttccggtaacgttaccgggtttaccgggttttaccggggggaacccgggtaaacgtacggttaccggtacgggtaaacgtaaccgtaaccggaaaacggttacccggtagggttacggtacccgtaaccgtcccgtaaacgttacgttaccgttccttttacccgttacgtaacccttttacccccggg

SEQ ID NO: 3825 - DNA, 638 bp, Homo sapiens
  misc_feature: GYAE6OF01EG6AV.39.31.C09.1.454.CMB.1.raw
  modified_base (306)..(306): a, c, t, g, unknown or other
  misc_feature (306)..(306): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccacatcaactgcaagtccagccagtagttgttttacacaggtaccaaacaataagaattacttcgcttaggtaccagacacgaaaccaggacacgcctacctaagttcgactactatttacgngggactagtccgtacccgggtacgtcccggggtccctagaccgtattcgacggtccggctacggcgggtactgacgtacagtacgtttacacctctacgaccatcgagccagcctgacgagtacgtagaagtagtgacgtacgttagtttattacgtgtacagtactagttaattagttagtacgttacctacgtacgttacggttttacgggaccggggtaaccgtaaggtccgtaggaacgtaaccgtaaccgtaaaccggtaacgttggtacggtcgtacggtacctaaccgtacgttaccgtacgtttaccttcgtaaccgttccccg

SEQ ID NO: 3826 - DNA, 711 bp, Homo sapiens
  misc_feature: GYAE6OF01EBWHN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggcctgtgtctctggcgagagggccaccatcaactgcaagtccagccagagtcgttttacacaggtccaacaataagaattacttcgcttcggtaccagtcagaaaccagacacgcctcctaagttcgctctatttactggcatcgtacccgggagtcccgggtcctgaccgtattcgacgcggcgagcgggtctggacgacagtactttcacgtcctcgacccagttaccgacggtacctaacggcccgttacggaccgacggtaccgtaaggtaaacgtaaagttccgggttaaggtacgttaaccggtttttaacgtttaacccggttacggttacgtaacggtaccgttaaggtttaacgttaagtttaacggttaacgttacccgttaccgtaacggttaacccggtttttacggggaacccgggggttaccccaaaggttccggtaggtaacgtaacgtaaccgtaaaacggttaacgtgggtacggttccgtacgtacccgtaacccgtacttaccgttagtccctttaccgtaaccgtttccccg

SEQ ID NO: 3827 - DNA, 877 bp, Homo sapiens
  misc_feature: GYAE6OF01ECHVU.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtcgccgtacggggacagtcgtgactacgacccagtctccagacctcccgtggctgtgtctcgtgggcgaggacgggcccaaccgtactccaacgtcgacgtaacgtaccacgccgtaggtacgtttacgtttaaccgacgtaacggtaccaaactaaataaagtaactttacgttcgtacgttacggtaccaagacgaaacggaaaccgaacggaccacgtcccttaacgttaagttcgtactacgttaacgtttacggtcgggtactaccggttacccggtaccggggtacccgggttaccccgggtaccctacggtacccggtacgttacggacgggccggtacggtacgggtccggggttacgaggtaacgtacgtaacgttacctttaccgacctttccaacctaccgtacgtaccgaacgtaccgacgtaccggtacgacggtacggtacgtaaggtaacgttaggtcggtaccgtttaagtttaacgttttacgttaacgttcgaacgtaggttaacttaagtttaacgtttcgttaacgtttcccgtaacggttaccggtttaaacggggtttacccgggtttaccggggggaaaccccgtaacggtacggtaccgggttaacgtaaaccggtaccggtaaaacccgttaaggggtaccgtttagggcccgggttaaacgacccccggttaataccccgttaccggtttaccttttaccggttaaccctttccgttaaccccggtttaccccgg

SEQ ID NO: 3828 - DNA, 734 bp, Homo sapiens
  misc_feature: GYAE6OF01AKWBF.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttgttttacacacggtaccaaacaaataaagtaatttacttcgcttggtaccagacaacgaaaccaggacacgcctactaagtgctctatttacgtggcactccgtacccgggtcggtcccggggtccctacgaccgtatcgaggccggacgacggtcgggtctaggacgacgtacgtactttaccaccttcctaccaccctactaccgtacgacgtacgcccgtggaccaggggtacctaggaaaggtgttacgggtacggtactttaaggttttaacttaccggtagttaccgagtacgttaagtttaactttaacgttaacggttaccgttacccttacgttaaacgggtttaccgggttttaccggggaaccccggggggttaaacctaaggtccgggttaagggaacggttaacgtaaacccggtaaaaaccgggtaccgttaggggtacccgtccgttaacggtaccccaacgttacgtttccggttaccgtttccctttacgtaccccgtttcccg

SEQ ID NO: 3829 - DNA, 760 bp, Homo sapiens
  misc_feature: GYAE6OF01BY7KX.39.31.C09.1.454.CMB.1.raw
  modified_base (510)..(510): a, c, t, g, unknown or other
  misc_feature (510)..(510): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtgatcgacccagtcctccacgacctcccgtggctgtcgtctcgtgggcgaggcggcccacataccaactcgacaacgtccacgccaggtagtttgtttaaccacggtacgtaccaaactaaataagtaactttaccgttcgacgtttaccggtaccagtaccgaaacggaaaaccgacgggaacctaccgtacccgttaaccgttaaggttccgccgttaccttaagttttaccgggcgggacttaccggtacccgggtacccgggggtaccggtccccgggtacctacggacccgttacgtccgacggcggtcggacggtccggtactaggacacgtacgttacgttccaccctcaccgacctagtaccagccncgccgtacgcgtcgagtagagtgtaggtacgtacgtttacgtttacgtgttcgacgttacgtagttaacgtttatacggttaacgttcgtacgttaccggttacggttacccgggttcggggtaacccgacgtacggtcggtacggtaacgtaaaccgtaaccggtaaccgtacggttacggaccgtactacccggtaacctacggttacttcccggtttactttccgttcccgttaacccggttccccg

SEQ ID NO: 3830 - DNA, 749 bp, Homo sapiens
  misc_feature: GYAE6OF01AINCV.39.31.C09.1.454.CMB.1.raw
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (458)..(458): a, c, t, g, unknown or other
  misc_feature (458)..(458): n is a, c, g, or t
  modified_base (480)..(480): a, c, t, g, unknown or other
  misc_feature (480)..(480): n is a, c, g, or t
  modified_base (713)..(713): a, c, t, g, unknown or other
  misc_feature (713)..(713): n is a, c, g, or t
tcagtcgcactagtcacgaccggtgctcgatttagacgtctcatcaaggaaggaaggggcagcaagatggtgttgcagacccaggtcttcatttctctgttgctctggatctctgtcgccgtacggggactatgtgatcgacccagtcctccagaccttccgtggtctggtcgtctcgtgggacgaggacggcccacactcgaactcgcaacggtccacgaccagtacgtttacgtttaccacgtacggtaccaaacgtaaataagtaacttcgttcgccgttacggtaccacgacgtaaacgaaccgnggaccncggtcctaacttagtntacctatacgttacgcggtacacgtaccggtacccgggtccggtcccgggtccctagcccgtagttaccgcgtcggaccgtacggtccgggtactagaaccggtaactacggttacttttaaccccncggttacctaccgaaccccgtnacggtaaaccgcctacgggtaaccctcgacggtacgacggtaggtaagtcgtaggtaggtactttacggtttattaccggacgttacggtaactcggttaaattacgtttacggtacttaccggtacttaccggttaacgggtttacccggttaccggggtaacccggaaccgtacggtacggtaagtaccgtaagtaacccgtaggtaccgttggaccggtctacggtaacncccgtaccgttggacctttcgtaccttcccgttccg

SEQ ID NO: 3831 - DNA, 669 bp, Homo sapiens
  misc_feature: GYAE6OF01E2BXF.39.31.C09.1.454.CMB.1.raw
  modified_base (310)..(310): a, c, t, g, unknown or other
  misc_feature (310)..(310): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagaggccaccatcaactgcaagtccagccagtagttcgttttaacacaggtaccaaacaataagtaattacttcgacttggtaccagacaacgaaaccagaccacgcctacgtaagttcgactctatttacgnggcagtccgtacccgggtcgtcccggggtaccctgaccgtacttcgagtccggcgacggccgggtctaggacgacgagtacttttaccgacctctaccgaaccagtaccagtaccgacgcccgtacgacgacggtactaggtaaacgtagttggtcggtacgttaacggttttaattaccgtacggtcacgtactaacgttaatttaagtaacgttacgttaccttacgtaaggtttaccggttttacggggacccggggtaaccgtaacggtcgtaggactaacgtaaaccgaaacggtacgtaggtcgggctacgaccgtaacctacgttcttacgttcttaccgtccgttaccccg

SEQ ID NO: 3832 - DNA, 834 bp, Homo sapiens
  misc_feature: GYAE6OF01EBOS7.39.31.C09.1.454.CMB.1.raw
  modified_base (119)..(119): a, c, t, g, unknown or other
  misc_feature (119)..(119): n is a, c, g, or t
  modified_base (130)..(130): a, c, t, g, unknown or other
  misc_feature (130)..(130): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtnccgtacggganatcgtgatcgacccagtctccagacctcccgtggctgtgtctcgtgggcgaggacggccaccgataccaactgacaacgtccacgccgagtagttacgttttaacacgtaacggtacccaaactaaataaagtaaactttaaccgttcggtccgtttacggtaaccgaagaccgaaaacgaaaccgacggaacctacgtaccttaccgttaagttcgtacctacttacgtttacgtcggacctacgttacccggtacccggggtaccggttcccggggttacccgtcgtaaccgttaacttcggaacggccgggactacgggtcggttacgtacgaacgtaacgtacgttacgtttcccgaaccttccctaccgaaccctacgtcctagaccaccgtccgtacgacgtacggtacgtagaacggttaggttcgtacggtacgttttaaggtttacctacggttcgaccgttagtaacgttaacgtttaatttacgttaacggttaccgttacccgtaaggtttaaccgggtttaccgggtttaacccgggggaacccgggttaaccgtacgggttacggttaacgggtaacgttaaaccgtaaaccggtaaaacggtacgttacgggtacgtaccggttaacccgtaaccgtaccgtttacgttacccgtttccggtttaaccttccggttcccgtttaccccg

SEQ ID NO: 3833 - DNA, 1082 bp, Homo sapiens
  misc_feature: GYAE6OF01C1NFX.39.31.C09.1.454.CMB.1.raw
  modified_base (225)..(225): a, c, t, g, unknown or other
  misc_feature (225)..(225): n is a, c, g, or t
tcagtcgcactagtcacgaccggtgctcgattagacgtctcatcaaggaaggaaggggcagcaagatggtgttgcagacccaggtcttcatttctctgttgctctggatctctggtgcctacggggacatcgtgatgacccagtcctccagactccctggctgtgtctcgtgggacgagacgggccaccatcaactgcaagtccagccagagttgttttacaacncggtaccaaacaataagtaattactcgtccttagtaccagacaacgaaaccaggacacgtacctaccgtaagttgcctactacgtttacgtcgggactacgttaccggtacccggggtaacggtccccggggggtttcccttacgggaacccccggttaatttacccgaacggggtaccgggtcccgaacgggtcccggggggtttacctacggggtaaaccgaaacccggttaagggttaaccgttttttaaccccgtaaaccgtttccccgtttaacccgtaaaacccccgtttaaactaccccggtaaaccggggtaaaacccgttttacccggggacccccgtttaccgggtaaaaccccgggtttaagggggacccctttaaacggggaaaaacggtttacggttttccgggttaaccggggggttaaaccctttaaaggggttttttttaaccgttaaccccgggttttaggtttacccgaaacccggtacgggttttaaaaactttaaggtttttaaaaaaccggtttacggggtttaaaccctttaacccggttaccggttaaaaacccgggttttttccgggggtttttaacccgggggggaaacccccggggggtttaaaaccccgttaacgggaccggtttaaacccgggggggaaaagttaaacccccgggtaaaaacggtaaaaaaccccccgggttttaaacgggttgggttttaaaacccggggggccccgttttaacgggtaaccccccgggttaaaaaccgtttcccgttttaaactttacccccggggtttttaaacccgtcccgttttaaaacccccgttttacccccccccgggggg

SEQ ID NO: 3834 - DNA, 717 bp, Homo sapiens
  misc_feature: GYAE6OF01BX5NB.39.31.C09.1.454.CMB.1.raw
  modified_base (378)..(378): a, c, t, g, unknown or other
  misc_feature (378)..(378): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagacctccctggctgtgtcctcgtggggcgaggacgggacccaccgataccaaacgtgaccaaggtcccagaccctaggtagttcgttttaacacgacggtaccaaactaataaagactttactcgtcttacggtaccagtcaagaaaccagacacgccttactaagttgcctactagttacgtcggcactccggtacccgggacggttcccggggtccctagacccgtnttccgagcggacacggtcgggtctggatacagtacttccgacctctccacctatacgacgctacgccgtgacgaggccgtaagaagacgtaggtcgtagttaacgtttacgtacgtcgtacgtagtaacgtagtttattaacggttacgttaaccgtaccgttaccgtaacgggttttcccggggttttaaccggggaccccgggggtaacctaccgggttaccggtaagggtaacgtaaccgtaaaccgtaaaaccgggtacccgtagggttacggaccgttaccgtaaccctacccgtaattcccgttagttacccgtttcctacctttacccccgg

SEQ ID NO: 3835 - DNA, 787 bp, Homo sapiens
  misc_feature: GYAE6OF01DJZ0R.39.31.C09.1.454.CMB.1.raw
  modified_base (184)..(184): a, c, t, g, unknown or other
  misc_feature (184)..(184): n is a, c, g, or t
  modified_base (548)..(548): a, c, t, g, unknown or other
  misc_feature (548)..(548): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtcgccgtacggggactatcggtgatcgacccagtcctccagacctcccgtggctgtgtctcgtcggngagacggccacactcaatcgacaacgtccgagaccgaagtacgtttacgttttaaccacgtaacggtaccaaaactaagtaaaacgtaatttaccgttacgtcgttacggtaaccaacgacgaaacgaaaaccgacggaaccgtacggtacccttaaccgttaagttcgacttacgttaacgtttacggtacggtacgtaccgtaccgggtaacccggggtaccgggttcccggggttccctacggaaccgttaacgtaaccgagggtaccggtcgacgggtacggtcgtaaggaacgtaacgtaacgttactttaccgaacctttccgtaacctaccgtaactcggaaccgacgtacgtccgngaaccgtacgtacgtaagaaacgttgtacgggtacgttacgttaaggttttactcggttacaacgttacgaaacgtttacgtttaaacttaggttacgaaccgtttccgtaacggttacgttttaacgggggttccggggaaccgtaaccgtggtaccgaacgtaacgtaaacctcggtaaaacgtgtcggtacggctaccggactacgtaagttcttaacttcctactccgttacccg

SEQ ID NO: 3836 - DNA, 691 bp, Homo sapiens
  misc_feature: GYAE6OF01BRT24.39.31.C09.1.454.CMB.1.raw
  modified_base (166)..(166): a, c, t, g, unknown or other
  misc_feature (166)..(166): n is a, c, g, or t
  modified_base (180)..(180): a, c, t, g, unknown or other
  misc_feature (180)..(180): n is a, c, g, or t
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtntctctgggcgaggngggcccaccatcaactgcaagtccagccagagttacgttttacactacggtaccaaacaaataaagtaaactttacttcgtcttaggtaccagacaagaaaccaggacacgcctactaagttgctctagtttacgtcgggctacgtccgtacccgggtacggttacccggggttccctcggacccgtnttcgacgcggcaggtcggtcgngacgacagttattccgtacctctaccaccgtatcgagtcacgtccgtcggacacgggcgtaacgtaagtacgtgggttacgtacgtttaagttttaacgttaccgttgtacgtaacgtacgttaagtttacttaagttacgttaccgttaccgtacgttacggtttaccgggttttacggggaacccgggtaaccgtaacgtcggtagggtaaacgtaacgtaacgtaaacggtaaccggtaggtacggtcgtaccgaccaccgttacttcgttacgttacctttccgtcctttacccccg

SEQ ID NO: 3837 - DNA, 855 bp, Homo sapiens
  misc_feature: GYAE6OF01EIZUY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctcgtggtgccgtacggggacattcgtgatcgacccacgtcctccagtacctccccgtggtcttgtgttccgtcgtgggcgaggacggccaaccactactaacgtcgactaacgtccacgaccgtaggtacgtttagtttaaccacgtaacggtaccaaactaaataaagtaacgtttaccttcgtacgttacggtacctacgaccgaaacgaaaaccgacggaacctacgtacccgttaacgttaacgttcgtactaccttaacgttttccgtcggggtacctacgtttaccccggggtaaccccgggggtacccgggttcccgggggttaccctacgggtacccgttacgttacggaccggtaccggtaccggtcggtaccgggtcgtacggaacggtaccgtaacgttactttccgtaccttaccgtacccgtaacctactaccggacgtaccgaccggtcccgtagggtacccgtacgggtactagggtaaaccggttagggttacgttacgggtacgttttaacggtttactttacggttaccgtaagtacgtaaccggtttaagtttaacgtttaccgttaaggttaccgttaccgttacggttaaccgggtttcggggtttaacccggggacggggttaaccctagggtacgtaaccgggtaatacggtaaccgtaacggtacggttggccgtacgccgtaactacgtcttaccgtacgtttcctcgttccgtacccg

SEQ ID NO: 3838 - DNA, 866 bp, Homo sapiens
  misc_feature: GYAE6OF01A92ED.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctggctgtgtctcgtgggcgaggagggccaccatcaactgacaacgtccagccagagttgtttacacgaggtaccaaacaaataagtaattacttcgtcgttacggtaccagacaagaaaccgaggacacgtcctaccgttaagttcgactactaagtttacgtcgggctacgtccggtacccggggacggttcccggggtccctacggacccgtagttaccgacggccggacgacgggtcggggtcgtacggtaagaacgtaggttaacctttccgaaccttccgtacctaaaccctagttacccgacggtaccgtaaccggcccttacgggaccgtacgggtacgttaacggaaacggtaggttacgggttacggttaacgtttacggtttttaacgttaaccggttacggttaacgtaacggttaacgtttaaagttttaaacgtttaacgtttaacgggttaacccgtttaccgttaaccggttaacggggttttaaccggggtttttacccgggggggaaaccccgggggtaaccgttaacggggttcggtaaacggggtaaacggttaaaccgttaaacccgggtaaaaccgggttaacggttacggggttaacccgggtccggttaaccggtaacccctaaccgttaccgttttccggttaacccgttttcgttaaccccgttaccccgtttaccccccgg

SEQ ID NO: 3839 - DNA, 696 bp, Homo sapiens
  misc_feature: GYAE6OF01BU8NY.39.31.C09.1.454.CMB.1.raw
  modified_base (322)..(322): a, c, t, g, unknown or other
  misc_feature (322)..(322): n is a, c, g, or t
  modified_base (429)..(429): a, c, t, g, unknown or other
  misc_feature (429)..(429): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggagggccaccatacaactgacaacgtccagccagtagttcgttttacacacggtaccaaacaataagtaattacttcgtcttacggtaccagacaacgaaaccgaggaccagccctaccgtaagttcgactactagtttacgngggactacgtccgtacccggggacggtcccgggtccctacgacccgtatcgacggtccgacgaggtcggtctggacgacacgtactttacacttcctaccacctacncgacgcacggtcctacgcgacggtcgtaagaagtacgttggtacggaactttagttttaacttcgttacgtacgtagtacttaagttagtttaactacggttacgtacctacggttacggtttacggtttaccggggacccggggtaacctaggtacggtaggtaacgtaacgtaaaccgtaaacggttaacgttggtaaccggtcgtaccgaaccctaccgttacgttaccttaccgggtttccttaccgttacccgttacccccg

SEQ ID NO: 3840 - DNA, 756 bp, Homo sapiens
  misc_feature: GYAE6OF01BZYYR.39.31.C09.1.454.CMB.1.raw
  modified_base (176)..(176): a, c, t, g, unknown or other
  misc_feature (176)..(176): n is a, c, g, or t
  modified_base (282)..(282): a, c, t, g, unknown or other
  misc_feature (282)..(282): n is a, c, g, or t
  modified_base (336)..(336): a, c, t, g, unknown or other
  misc_feature (336)..(336): n is a, c, g, or t
tcagtcgcactagtcacgaccggtgctcgatttagacgtctcatcaaggaaggaagggcagcaagatggtgttgcagacccaggtcttcatttctctgttgctctggatctctggtgccgtacgggacatcgtgatcgacccagtctccagactcctggctgtgtctctggcgagnggccacacgtcaactcgacaagtccgagccagtacgttgtttacacgtaggtaccaaataataacgtaattaccgttacgtcttaggaccagtcgaacgaaaccgngacacgtcctaccgttaagtcgtctcgtatttcgcggtctagtccgtaccgggngttcccgggtcctacgaaccgttacttcgacgtcggtacgacggtccggttcgtaggaaccgacgtaacggttacttttaccgaaccttccggtacctaccgtaacgtcctaacggacgtacggtaccctaggtaccgtaaacgggtccgtaaagggttaactaggttaccggttcggtaactttaacgggttttacctaaccgttacggtaacgtacggtactaaaggtttacgtacgttaacgttacgtaccgtttaggttaaccgtttaccggtttaccggggaacccggtacgtacgggtacctaaggggtaactaccggtaaccgttaaaacgccggttttagcggttaaccctcgttaacccgtaccttacgggttccttaccgggttacctaaccgtcccgtttaaaccccgg

SEQ ID NO: 3841 - DNA, 705 bp, Homo sapiens
  misc_feature: GYAE6OF01CQ9YQ.39.31.C09.1.454.CMB.1.raw
  modified_base (329)..(329): a, c, t, g, unknown or other
  misc_feature (329)..(329): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgttacggggacatcggtgatcgacccagtctccagactcccgtggctgtgtctcgtgggcgaggacgggcccaccatccaactgacaagtcccagccagtacgttagttttacacgaggtaccaaacaaataaagtaacttacttcgcgttaggtaccacgacaacgaaaccaggacacgtacctaccttaagtcgacctaatttacgngggtaccacgtccggtacccggggacggtcccggggtaccctaggtaccgtagttcgacggccggtacgaggtcgggtcctaggacgaacagtactttccacttaccgtacaacccagtacgacgtacgacggtcctagaccgtaggtactaacggaaagtagttacgggtaggtacgttaagttttacgttacgtgtaaccgtacggtagttaagtttaatttaacgttagtttacgtaccgttacgtacggtttaccgggtttcggggaacccggggttaacaacggtcgtaggaacgtacgtaaaccgaacgtacggtggtcggtaccgtcgaccgtacacgttactagtccttactccgttcccgttacccg

SEQ ID NO: 3842 - DNA, 848 bp, Homo sapiens
  misc_feature: GYAE6OF01DJVSB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtagatcgacccagtctccacgacctcccgtggctgtgtctcgtgggcgaggacggccacatacaactgcaacgtccagccagtagttgtttacacgacgtaccaaactaaagtaactaattaccttcgtccgttaggtacccagacgaaacgaaaaccacggaaccacgtaccttaccgtaaggttcgacttaccttaacgttttacggtacgggtaacctacgtttacccccgggtaacccggggtaacccggggtttcccccggggttacccgttacgggtaaacccgttacttaccggaaccggccggtaccggaacggtccggggtcgtaaggaaccgtaaaccgtaacgttaaccgttttacccaacccttccgtacccacctaactacggacgtacgtaccgtccgtacgaacgacggtacctaagggaaacgtcggttacggtacgggttaacttaacggttttttaacttaccggttaacgttacgtaacggtttaacgttaaagtttaacgtttacggtttaaagtaacccgtttccgtaaccggtttaacgggtttaccccggggtttaacggggaacccgggttaactacgggttcgggtaaacgtaacgtaacgttaaaacggaaacccggttaggttcggtacggtacgtaaccgtacgtaccgttacttcgttaccgttcttacgtccccgtttaccccg

SEQ ID NO: 3843 - DNA, 856 bp, Homo sapiens
  misc_feature: GYAE6OF01DCHRD.39.31.C09.1.454.CMB.1.raw
  modified_base (131)..(131): a, c, t, g, unknown or other
  misc_feature (131)..(131): n is a, c, g, or t
  modified_base (242)..(242): a, c, t, g, unknown or other
  misc_feature (242)..(242): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacgggganatcgtgatcgacccagtcctccagtacctcccgtggctgtcgtctcgtgggcgaggacggccacatcaactgacacgtccagaccagtagttcgttacacgacgtaccaanaaataagtaacttaccgttcgtcgttacggtaaccacgacgaacgaaaaccgaggaccgtaccgtacccttacgtaaacggttcaccttactttaacgtttaccgcgggtacctaacgtaccccggtaacccggggtaccgggttccccggggtacccctacggtaaccccggtattaccgacgggtacccggacggtaacgggtccggggttaccgtaaggaaacgtaacgtaaacggtttccttttaacccacccgtttaccaaccccgtaacctaccgtaaccgtacgtaacccgaccggtccgaacgggtaccgtacgggttaaccgaaaggtaaaggttgttttaccggggaacggtttaaaccttttaacggttttaacttccggtacgttaaccgaggtaactttaagtttacgttaaacgttacgtaaccgtccgttacggtaaacgggttttcccggggtaaaccgggggacccggtaacgtaggtacggtaacgtaacgggtaaaccctaaaggaaaccgttccggttaagggccgttacccaacgtccccgtagttaaccgtttcgtaccggtttaccttaacccgtcccctttaaaccccgg

SEQ ID NO: 3844 - DNA, 811 bp, Homo sapiens
  misc_feature: GYAE6OF01BMN9R.39.31.C09.1.454.CMB.1.raw
  modified_base (246)..(246): a, c, t, g, unknown or other
  misc_feature (246)..(246): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagtacctcccgtggctgtcgtctcgtgggcgaggacggcccacatcaactgacaacgtccagccagtagttacgtttaacacgacggtaccaaanaataaagtaactttacttcgtacttacggtaccagacaaacggaaacccgaggaaccacggaccttacctaaggttcgccttactactttacggtcggactacgttacccggtacccgggtacggttccccgggtaccgacgtaccgtattaccgacggaccggtacgacggtcgggtacgtaggacgaacgtacgtatttacccgaccttccaccctacgaccttacgaccgtacgacggtcctaggccgtacgggaccgtaagtaacggttaggtaccgggtaggttaccgtttaacgttttaacgttacgtacgttaaccgtagtaaccgtttaaggtttaacgtttaagttacgttaccgtaccttaaggttacccgggtttaccggggtttaacccgggggaaacccgggttaacgtaacgggtaccgtaaacgggtacgtaaaccgttaaccggaaaaccggttacggttaccgggtacggtaccctaaaccgggttcctaacccgttaacggtttccgttaacggttacccgttttacccgtacccgtttaccccccg

SEQ ID NO: 3845 - DNA, 711 bp, Homo sapiens
  misc_feature: GYAE6OF01CMA1X.39.31.C09.1.454.CMB.1.raw
  modified_base (183)..(183): a, c, t, g, unknown or other
  misc_feature (183)..(183): n is a, c, g, or t
  modified_base (523)..(523): a, c, t, g, unknown or other
  misc_feature (523)..(523): n is a, c, g, or t
  modified_base (685)..(685): a, c, t, g, unknown or other
  misc_feature (685)..(685): n is a, c, g, or t
  modified_base (690)..(690): a, c, t, g, unknown or other
  misc_feature (690)..(690): n is a, c, g, or t
  modified_base (695)..(695): a, c, t, g, unknown or other
  misc_feature (695)..(695): n is a, c, g, or t
  modified_base (700)..(700): a, c, t, g, unknown or other
  misc_feature (700)..(700): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtgatcgacccagtcctccaacgtccctcccgtggcgtgtcgtctcggngggcggacggaccggacccaccataccaactgacaacgtccagccaggtagttacttacacgacgtaacaaacaaataagtaacttactcgtacgtacgtaccgagaacgaacgaaacgacggacacgtacctaacgtaagttcgccttactaacgtttcggacggacttaccggtccccggtaacccggggtaccgggttacccgggtccccgtaacggtaacccgtacgttacggaccgggaccggtacggacgggttaccggttacgaaggtaactaaccggtaagttcctttaccaccttacaacccgaacactacggactaccgacgtccacggnggacgtacgtaagaacgtggttaggtcgttaacttaggtttaactcgtagacgtaacgttattaagttaacgtaacgttcgttacttaccgtacgtaacgggtttccgggtaacgggaccggtaacacggtacgagtacacgtaacgacgtgtcgagcctancttanccgtntcctntccgtcctccg

SEQ ID NO: 3846 - DNA, 660 bp, Homo sapiens
  misc_feature: GYAE6OF01D5Z8M.39.31.C09.1.454.CMB.1.raw
  modified_base (300)..(300): a, c, t, g, unknown or other
  misc_feature (300)..(300): n is a, c, g, or t
  modified_base (363)..(363): a, c, t, g, unknown or other
  misc_feature (363)..(363): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaaataagaattacttcgcttggtaccagacaagaaaccaggacagcctacctaagttgctctatttacgngggactacgtccgtacccggggagtcccggggtccctgaccgattcaggcggcaggcgggtcngagacagtactttcactctcgaccatcacgacacgtctagcgaggcgtagaacgtagtggtaggtacttagttttactttacgtcgtacgacgtactaagtttaatttaagtaacgttacgttacccttacgttacggttaccggtttttaccggggacccgggggtaaccgtaacggtccggtaagggtaagtaaaccgtaaacggtaaaaccggtaacgttacgggtacggttaccgtacggaccctaaccggttacttaccgttaccgtttaccttccgtaccgtttacccccg

SEQ ID NO: 3847 - DNA, 819 bp, Homo sapiens
  misc_feature: GYAE6OF01EIW3E.39.31.C09.1.454.CMB.1.raw
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
tcagtcgcactagtcacgaccggtgctcgatttagacgtctcatcaaggaaggaaggggcagcaagatggtgttgcagacccaggtcttcattttctctgttgctctggatctctggtgccgtacggggacatcggtgatcgacccagtcctccacgacctccctggctgtgtctcgtgggcgaggacgggccaccatcaactgacaagtccagccgagtagttagtttaccacacggtaccaaacgtaaataagtaatttacgtcgtcgttacggtaccacgacaacgaaccgaggacacgcctacgtagtcnctctattcgnggctagtccggtaccgggtacgggtcccgggtccgtcgaccgtattcgacggccggacgcggcggtacgtaggaacgacgtaacgttactttacgacccttctaaccacctactaccgacggctaccgtacccgtaggaccgttacggtacgtaaggtaaagtacggtttgggtaacgttacgttttaacgttttaacggtttaccgttaggtaccgtaacggttacttaaaggtttaacgttacggtttaaacgttcccgttaaccgttacggtttaaccgggttttacccggggtttaccggggggtaaccccgggtaaccgtaacggggttaccgggtaaaggggaaccggttaaacgtaaacccgtaaaaacgggggttccgtttaaggggtaccgggttaacccgttacggtaaccccccgtttaaacgttccggttttaacccggttaccgttttacctttaaccccgttcccggttttaacccccccg

SEQ ID NO: 3848 - DNA, 799 bp, Homo sapiens
  misc_feature: GYAE6OF01DZ1K2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctcgtggtgccgtacgggacatcgtgatgacccagtcctaccagacctcccgtggctgtgtctcgtgggcgaggacggccaccgactccaaacgtcgacgaacggtccagaccgaaggtagttgttttaaccgacgtacggtaccaaaacaaagttaacgtaacttacttcgtacttacggtaaccagtacaaacgaaaccgaggaacctacgtaccttaccgttaaggttcgaccttacgttaacgttttacggcgggtacctaacgtttacccggtaacccgggggtaccggtttacccccggggtccttaccggtaacccgttaacgttaccggaacggccggtaccgtagggtcccggttacgtaggaaccgtaacgtacgttacttttaccgaccttcctaaccgacctaacgtacgaacggtaccacggtcctacggaccgtaggtacgtaagtaaacggtcgtggtaaccgtacgtttaagtttacgttacggtataccgtacgtacttaagtttaacgtttaagtaccggttacttcccgtacggttaaggttaccggtttaccggggaccgggtaactagggcggttaacgtaacgtacgtaaccggtaaaccgtggttacggagacccgtgtaacctaccgtacttacggttactttcccttaccgtaccggttccccg

SEQ ID NO: 3849 - DNA, 694 bp, Homo sapiens
  misc_feature: GYAE6OF01EZBKV.39.31.C09.1.454.CMB.1.raw
  modified_base (328)..(328): a, c, t, g, unknown or other
  misc_feature (328)..(328): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgaggacgggccaccatcaactgacaacgtccagccaggtagttcgtttaacacgtacggtaccaaacaaataagtaactttacttcgtcgttaggtaccagacaacgaaaccaggacacgtcctactaagttcgcttacgtactttacgnggctacgtccgtaccggggacggtcccgggtcctcgaccgtacgtcgaggccggacgtacggcgggtactagacgacgtagtactttccacttctacacctagtcgacgctacgtccgtacgacgtaggtctaagggaacgtcgttggtacggttactttaggtttacgtactacggtactaagtacgttaagttaattaggtacgttctacccgtagttaacggttcggttacgggggacccgggaactaagggccgtaagggacttaacgtaaccggtaaacggtcgtacgggtacggtctaccccgtaacgttacccgttacgtttaccgtcccgttttaacctcccgtccgtttaacccccg

SEQ ID NO: 3850 - DNA, 740 bp, Homo sapiens
  misc_feature: GYAE6OF01BG3OD.39.31.C09.1.454.CMB.1.raw
  modified_base (307)..(307): a, c, t, g, unknown or other
  misc_feature (307)..(307): n is a, c, g, or t
tcagtcgcactagtcacgaccggtgctcgatttagacgtctcatcaaggaaggaaggggcagcaagatggtgttgcagacccaggtcttcattttctctgttgctctggatctctggtgcctacggggacatcgtgatgacccagtctccagactccctggctgtgtctctgggcgaggagggccaccatcaactgcaagtccagccagtagttgttttacacagtaccaaacaataagaattacttcgcttcggtaccagacaagaaaccaggacacgcctacctaagttcgctactattttacgngggctacgtccggtacccggggtacggttcccggggttccctacggaacccgtactttaccgaacggtccggaccgacggtccggggtcctaggaacgaaccgtaaggttacttttaccgaccttcctaccctaaccctacgtaccacggacccacgtccgtcggcgtagggtccgtaaggtaaagtagttacgggttggtacgtttaagtttttacttacgttagtacgtagacgttaagttaactttaacgtttacgtacgttacccttacgtaacgggtttaccggttttaccgggggacccggggtaacacggtacgtaagggtaacgtaaacgttaaccgaaaaccggtacgttcggttaacggcgttaccgaaccgtaacccgttactaccgtttcttttaccgttaccgttacccgtttacccccg

SEQ ID NO: 3851 - DNA, 837 bp, Homo sapiens
  misc_feature: GYAE6OF01BPKB4.39.31.C09.1.454.CMB.1.raw
  modified_base (795)..(795): a, c, t, g, unknown or other
  misc_feature (795)..(795): n is a, c, g, or t
tcagtcgcactagtcacgaccggtgctcgatttagacgtctcatcaaggaaggaaggggcagcaagatggtgttgcagacccaggtcttcatttctctgttgctctggactctcgtggtcgccgtacgggacatcgtgatcgacctacgtcctccgacgtacctccgtggtctgtcgtcgtcgtgggcgacggcggaccctactacgtaccaacgtggaccaacggtccacgaccgtagtaacgtttcggtttaaccacggtaacgtaccaaaactaaagtaaacgttaaccgtttacgtaccggttacgttaacggaaccaacgaacgaaaccgaaacgacggaacgacgtcccgttaacgttaacggttcgtaaccgtacttacggttacgtagggtacctaccggttaccggtaacccggggttaccggttcccggttcaacggtacccgttgtaaccgcgggtcggacggtcggtcgggtacctaggtaaggactacgttactccgtaccgtaccttacgaccgtaactacgacgtcgaccggttcgtacgcgtaggtagtacgtacgtaggtacgttcggtacgtttaagttaccctaggttacccgtagtaacttacgttaagttacccgttaaaggttccggttaaactttccggtaacgttacggggttaacgggtttccccgggaaaccggttacaaccgggttagtaccggtaaagttaaccccgaaaagggttaaacccgtagtttaccggggcccgtaaactcccgggttaacaacccggttnttacccggtttaccgttacttacccggtttccgtaccccccg

SEQ ID NO: 3852 - DNA, 884 bp, Homo sapiens
  misc_feature: GYAE6OF01EQDOB.39.31.C09.1.454.CMB.1.raw
  modified_base (168)..(168): a, c, t, g, unknown or other
  misc_feature (168)..(168): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtntctcgtgggcgaggacgggccacactcaactgacaacgtccagacctagtagttcgttttacaacgtacggtaccaaactaaataaagtaactttacttcgtacgtttacggtaaccagacgaaacgtaaaccgaggacacgtcctaccgttaaaggttcgtacttactaagtttaccgtcggggtacctacggttacccggtacccggggtaccgggtccccggggtccctacggtaacccgtacgttaccgacggtaccggacgtacgggtaccgggtacgtacggacgtaacgtagttaactttccgaacgttccctacgtaaaccctacgtaccgtacggtaccgtaacgcccttaggacccgtaacggtaccgtaagaaacggttgttcggttacgggtacttttaaacgtttttacgttaaccggttggttaacctacggtttaaggtttaaacgtttaacgttttaacggttaaacgttacccggttttaccgtaacggtttaaccggggttttaacccggggttttaccgggggaaccccgggggtaaaccgtaaccggggttccggtaagggttaaaaccgtaaacggttaaaccccggtaaaacggggttaaccggtttagggtacgggtacccgttaccgaacccgtaaacccgttctttaccgggtttacctttacccggttacctttacccggtttacccccg

SEQ ID NO: 3853 - DNA, 788 bp, Homo sapiens
  misc_feature: GYAE6OF01BIWMC.39.31.C09.1.454.CMB.1.raw
  modified_base (315)..(315): a, c, t, g, unknown or other
  misc_feature (315)..(315): n is a, c, g, or t
  modified_base (330)..(330): a, c, t, g, unknown or other
  misc_feature (330)..(330): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtctccacgacctccctggctgtgtctcgtgggcgaggacggccaccatcaactgacaacgtccacgaccaggtagttcgtttacacgtacggtaccaaactaataacgtaacttacgttcgtacgttacggtaccagacaacgaaccgaggacacgacctacgtagttcncttactactttacgnggtacctagtacccggtaccggggacggtcccggggtcctacgtaccgtagttaccgacggccgtacgcggtaccggtctaacgacgacgtacgttctttaccaccgttacacccgtaacctagtaccgacgacacggtccgttcggacgaggtaccgtaagaaacggtcgtaggttacgggtacctttagtttaaccgtcgtaggtactaacggtattttaaacgggtttacttaacggttacggttaaacccgtttccggttaacgttaccggggtttaaccccgggggttttacggggaaccccggttaaacggtacggggtccgttaaacggggtaaaccgttaccggttaaaaccgaaacgggtttcgtacgggtacggtaccgttaacccgccttaacccggttactttcccgggttaccctttacttaacccggttcccgtttacccccgg

SEQ ID NO: 3854 - DNA, 712 bp, Homo sapiens
  misc_feature: GYAE6OF01ECHJY.39.31.C09.1.454.CMB.1.raw
  modified_base (413)..(413): a, c, t, g, unknown or other
  misc_feature (413)..(413): n is a, c, g, or t
  modified_base (484)..(484): a, c, t, g, unknown or other
  misc_feature (484)..(484): n is a, c, g, or t
tcagtcgcactagtcacgaccggtgctcgatttagacgtctcatcaaggaaggaaggggaagcaagatggtgttgcagacccaggtcttcatttctctgttgctctggatctcgtggtgccgtacgggacagtcgtgactcgaccagtcctacacgacctccgtggtctgtgtctcgtgggcgaggacggccacatccaactcgactaacgtccaacgcgtaagtagttacgtttaaccacgtacggaaccaaataaactaagtactttaccgtcgtacgttacgaaccgagtaccaaacggaaaccgtaggactacgtcccttacgttaacgtcgtacttacgttaacgtttacggcgggtactaaccggttccggtaccgggtaccggttcccgggtacctacggacgttntaccgcggtccgacgtcgggtcgtacgtagacgtacaagttccttcaccgttacaccaactagtacgaacnccgtaacgtcctcgacgtagcgtaaggagttacggtgtacgtaagtttacgttactacgtctacgtagtacttaacgttaagttacgtaacgttcgtacgtacggttaacggttcgggttacgggtaaccggagtaacgtacgaacggtacgtaacgaacgtaaacgtcgtcgtacgtactacgaccgtaaccgttctcgttaccgttctacgttccgttcccgtacg

SEQ ID NO: 3855 - DNA, 814 bp, Homo sapiens
  misc_feature: GYAE6OF01CL6WQ.39.31.C09.1.454.CMB.1.raw
  modified_base (375)..(375): a, c, t, g, unknown or other
  misc_feature (375)..(375): n is a, c, g, or t
tcagtcgcactagtcacgaccggtgctcgatttagacgtctcatcaaggaaggaagggggcacgcaacgatggtgttgcagtacccaggtcttcatttctctgtgctactggatctctggtcgccgtacggggacagtcgtgatcgacccgtagttctccgagacctaccgtggctgtgtctcgtgggcgaggacgggccacgagtacgaacgtcgacgtacggtccgacggcctaagtacgtttcgttttaccacgtacggtaccaaacgtaaacgtaacgtaacgttaccttcgtacgttacggtaccaagactaacggaaaccaggtacacgtcccgttaccgtaagttcgacttacgtaagttttaccggnggtacctacgttacccggtacccggggtacggttccccggggttacctacggacccgttacgttaccggacggtccgggacgtacgggtccggggttacgtacggtaacgtacgtagttaccgtttacctaccgtccgtaccgtaccgtaacgtacgtaccgtaccgacggtccgtcggaccggtacggtaccgtaacggtaacgttacggttacggttcggtaacgttacgttttactacgttacggtacgtagtaccgttaacgttaacgttaacgttaacggttaccgtaccttacggtaccgggtttaccgggtttaccggggaaccggtaaccgtacgggtacgtgggtaactaaccgtaacgtaaaaccgtcggttaggtaccggacttacggactaccggtgttacgttacgttccgtccgtccgttcccgg

SEQ ID NO: 3856 - DNA, 811 bp, Homo sapiens
  misc_feature: GYAE6OF01DU7PU.39.31.C09.1.454.CMB.1.raw
  modified_base (165)..(165): a, c, t, g, unknown or other
  misc_feature (165)..(165): n is a, c, g, or t
  modified_base (794)..(794): a, c, t, g, unknown or other
  misc_feature (794)..(794): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactcccgtggctgtntctcgtgggcgagacgggccaccatacaacgtgacgaacgtccagaccaggtagttacgtttaacaaccgtacggttaccaaactaaagtaaagtaactttaccgttaccgtctttacgggtaaccctaggaccaaacggaaacccgaggaaccaccggtacccttaccgtaaagttcgtacttaccttaacgttttaccggtcggggactaccgtttacccggtaaccccgggggtaccgggtttccccggggttaccccgttacggtaacccggttaacgtttaccggaacggccccggggtacgtaacggggtccggggttcgtacggggaaaccgttaaccgtaagttaccgttttaccaaccgtttccgtaacccaacctacctacggacgacgaacgtccgttggaacccggacggaccgttaacggaagtacggttcggtagttacgtttaggttttacttaaccgtgttaaccgagtccgtaatttagttaacttagtaaccgttcctaacggcggtttacggtttccggggacccgggtaaatacgggacgttaggaacgtacgtaaaccgaaaccggtgttacggcgacttaccggaccaaaccgttctactttcggtntacccgtcgttaccccg

SEQ ID NO: 3857 - DNA, 735 bp, Homo sapiens
  misc_feature: GYAE6OF01E39FV.39.31.C09.1.454.CMB.1.raw
  modified_base (649)..(649): a, c, t, g, unknown or other
  misc_feature (649)..(649): n is a, c, g, or t
  modified_base (692)..(692): a, c, t, g, unknown or other
  misc_feature (692)..(692): n is a, c, g, or t
tcagtcgcactagtcacgaccggtgctcgatttagacgtctcatcaaggaaggaaggggcagcaagatggtgtgcagacccaggtcttcatttctctgttgctctggatctctggtgccgtacggggtacatcgtagatgacccagtctccacgactcccgtggtctgtcgtctcgtgggcgaggacggccaccatacaacgtgacgaacgtccacgccaagtagttagttttaacacgacggtacccaaacaaataacgtaatttaccttcgtcgttacggtaccagtacaacgaaaccgaggaacacgtaccctaccgttaaggttcgacctacctactttaaccgtgggtacctaacttacccggtacccggggtaccggggttccccggggttacccccgtcggtaaccccgtacgttacccacgggaccggtacgacgggtccggggttacgtcgaacggtaacgtacgttaccgttttaccgaccgttacctaccaccctataccgagtcctacggcctagaccgagggtcctaaggaacgtagtgtcggtatttacgtttaactcgtagtacgtaggtacttagttattagtacgtacgttactacgtagtttaccggttccggggacggaacccgtacggngtacggaacgtaaccgtaacaaacggtctacggcgtccgtaanaccgttaaactcgttcgttaaccttcctaccgtcctttccccg

SEQ ID NO: 3858 - DNA, 724 bp, Homo sapiens
  misc_feature: GYAE6OF01BP2TI.39.31.C09.1.454.CMB.1.raw
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtgccgtacggggacatcgtgatcggacccagtcctccagacctcccgtggcgtcgtgtcgtcgtgggacgaggacggacctacatacaactgacaagtccacgccagtagttacgtttacacgaacgtaaccaaacgtaagtaacgtaatttaccgttaccgtcgttacggtaaccacgacgaacgaaaccaggaactacgaccttacgtaagtcgctacgtattacgcggactacgtccgtaccgggtcggtccgggtcctcgaaccgtntcgngaccgcgtacgtccggtntacggacgacgtacgtactttccaacgttccaaccgtaaccacgtaacgaaccgtcaccggactacggaccggacgtaagtacgtaagtcgtcggtggtaatttaacggtttaattcgtacgtacgtaagccggtaatttaagttaacggttacttcgtaccttaagtaccggtttacgggtttaaccgggggacccggtaaccgtacggtacgaacgggactaaaccgtaaccgaaggttacgtaacggtcggttacccacggttacccttaacgtacgtttacccgttattaccgttccgtcgttaaccccg

SEQ ID NO: 3859 - DNA, 824 bp, Homo sapiens
  misc_feature: GYAE6OF01EWVZZ.39.31.C09.1.454.CMB.1.raw
tcagtcgcactagtcacgaccggtgctcgatttagacgtctcatcaaggaaggaagggggcagcaagatggtgttgcagacccaggtcttcatttctctgttgctctggatctctggtgccgtacggggacatcgtgatcgacccagtctccagacctccctggctgtgtctcgtgggcgaggacgggccaccatacaactgacaacgtccacgccgaagtagttacgttttacacgtacggtacccaaaacaaataaagtaactttacgttcgtacgtttacggtaaccagaccaaacggaaaacccgagggaaccacgtcccttaccgttaaaggttcgtaccttacttaacgttttaccggtacggggaccttaaccgttacccgggtaacccgggggtaccgggttccccggggttccctacggaccgtacgttccgacggccggacgacgggtccgggttactaggaacgacgtacgttactttaccaccgtcctacctaacctacgtaccgacgccgtacgtccgtacgaccggtacggtacgtaagggtaaacgtacggttcggtaggttacgtttaaacgttttaacttaccggttacggtacgtaggttacgtaaagttttaagtttacggtaacgttaccgttaaccgttaccggtacggggttttaaccgggttttccggggggaacccggggtaaactacgggtccggttaagggaaacttaaccggtaaaccgtaaacggtacggttggtaccgtcgtacggaccctaaccggttacttcgtttacgttacccttaccgtccgttaccccg

SEQ ID NO: 3860 - DNA, 746 bp, Homo sapiens
  misc_feature: GYAE6OF01BTKQA.39.31.C09.1.454.CMB.1.raw
  modified_base (543)..(543): a, c, t, g, unknown or other
  misc_feature (543)..(543): n is a, c, g, or t
  modified_base (730)..(730): a, c, t, g, unknown or other
  misc_feature (730)..(730): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtgccgtacggggacagtcgtgatcgacccagtctccagtacctcccgtggctgtgtctcgtgggcgaggacggccaccactacaactcgacaacgtccacgccgagtacgtttacgtttaccacgtacggtaccaaaactaaagtaaacgtaactttaccgttccgtacgttacggtaccgaagaccgaaacggtaaacccgaacggaaccgaccggtacccttaaccgttaaagttcggtacctacgtttaactttacggtcgggacctacgtaccccggtaccggggtaccggttccccgggtacccgtacgacccgtattaccggcggaccggcgtaacgggccgggttactaggaacgtagtacgttacctttcacttccacgacctacgtacacgctacgcgtcgagtacgcgtaagtagngttcggtacggttaacttagtttacgttacgtcgcgtaatcgttagttaacgtttacggtagtccttacggtacgtacgggtttaacggtttaccgggggacccgtagtacggtacgtaggaacgtaaagtaacccgtagggtacgttgggacggtctcccgaatccgttgttaccctttagttccnccccgttgttaccccg

SEQ ID NO: 3861 - DNA, 806 bp, Homo sapiens
  misc_feature: GYAE6OF01CRCRQ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggactcttcgtggtcgtccgtaacggggacatccgtagatacgacccagtctaccacgacctcccgtggcttgtcgtctcgtgggtcgaggacggtaccaccatacaactcgacgaacgtaccacgaccgagtagttcgttttacgactacggtaccaaactaaagttaacgttaacttacgttacgtaccgttacggtactacgaccgtaacgaaccgagaccgtacgtacccgtacgttaacgtcgtacgttacgtacttacgtacggactaccgtaccggtaccccggacggttacccgggtccgtacggtaccgtcgttcgacggacgggtaccgtacggcggtacgtccggagttacgacggtttactttacggtaacctcggttaaccctacctaacgtaccgaccggtactacccggtcgttaccggaaccgcggtaaccgtaggtaaacgtcggtaggtacggttacgttaacggttttacctttaaggttacggtaacgtgtaacgtttaacgtagttacgtaggttaaccgtaccgttacggttaacggtttccgggtaccgggtaccggtaacggtaccggtaggttacggtaacgtaccgtaaacggtaaacgtacgtcggttaccggacggtacccgtaacccgtactaacgttccgttattcccggttacttcccggtttaccccg

SEQ ID NO: 3862 - DNA, 964 bp, Homo sapiens
  misc_feature: GYAE6OF01E018W.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtcgccgtacgggacatcgtgatcgacccagtcctccagacctccctggctgtcgtctcgtgggcgaggacggccacatcaacgtgacgaacgtccagccagtagttactttaaccgacgtacggtaacccaaaactaaataaacgtaactttaccgttccgtacgttacggtaaccgaacgaccaaaaccggaaacccgaacggaacaccgtacccttaccgttaaaggttcgtaccttaacttaacgtttacggtacggggtacctaaccggttaccccggtaacccggggtccgggttacccccggggtcccgtacgggtaccgttaccgttaccggacggtccgggtacgtacggggtccggttcggtacggaacggaaccgtaggttacccttttaccgacccttccgtaaccctaaacctacttaccggaaccgtacgtaacccggtccgttacgggaccggtaacgggtacccgtaagggaaacgttagggttacgggttacggttaaacgttttaaacggttttacgtttaaccggttacggtaaccgttaacggtaacgttttaaagtttaaccggtttaacgtttaacggtttaccgtttacccgttaaccgggtttaaccggggtttttaacccggggttaccggggggtaaaccccggggtaacctaacgggggtacccgtttaaggggaaaaccgtttaaccgtaaaacccgggtaaaacccggtttacgggtacgggtttaaccgggtacgttaaccccgaacccggttaccgttttaaacccggtttcgtttaccccggttttaacgttccccccttaccggtttacccccccg

SEQ ID NO: 3863 - DNA, 651 bp, Homo sapiens
  misc_feature: GYAE6OF01AQ6X7.39.31.C09.1.454.CMB.1.raw
  modified_base (177)..(177): a, c, t, g, unknown or other
  misc_feature (177)..(177): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctggcgagnggccaccatcaactgcaagtccagccagagttgtttacactaggtccaacaaataagaattactcgcttagtaccagacaagaaaccaggacacgcctaccgtaagttcgctactatttacgtgggacctagtccgtacccggggacgtcccggggtccctaggacccgtattccgacggccggcgaggccgggtactagacgacaggtacttcactctaccaccatcgacgcacgccgtagaccgaggtctaggaagtacgtcggtacggtacttaagtttacttacgtcgtacgacgtacgtaatttaacttaatacggttacttaccgttacgacggtttacgtttaccgggaccggggtaccaaggtcggtaggactaacgtaaccggtaaacgtacggttaggtacggtacgtacgtacccgtaccgttacgttccgttacgttccctttacgtacccgtttaccccgg

SEQ ID NO: 3864 - DNA, 639 bp, Homo sapiens
  misc_feature: GYAE6OF01BZZQG.39.31.C09.1.454.CMB.1.raw
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtcctccagactccctggctgtgtctctgggcgagagggccaccatcaactgcaagtccagccagagttgttttacacaggtccaaacaataaagaatttacttcgcgttggtaccagcagaaaccaggacagtcctacctaagttcgctcatttacngggcagtccgtaccgggtagtcccggggtcctgaccgtactcgagcggcacggcggtcngaagcaagtactttcaacctctcgaaccagtacagcgacgcctgcgaggcgtagtaagatggtagtcgttatttagttacttgtacgtacgtcgtaacgttattagttaacgtacgttaccgttacgtacggttacggtttttacgggacccgggggtaaccgtaacggtacggtacggtacggtaacttaaccggtaaaaccgtaacggttacggtacgggtaccgttcgaccgaccgtaccttacttacggtttacctttccgtacgtttacccccg

SEQ ID NO: 3865 - DNA, 757 bp, Homo sapiens
  misc_feature: GYAE6OF01DROL2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtctccagtacctcccgtggctgtgtctcgtggcgagacgggccacgactcaactgacaacgtccagaccagtagttagtttacacgtacggtaccaaacaattaaacgtaactttacttcgtacgttggtaaccgagtacgaacgaaaaccgacggaaccgtacggtacccttaaccgttaacggtttcgaccttacctttaacgtttacgtcggggacctacgttacccggttaacccggggtaccggtacccggggttccctacggacccgtacttacgacggtcgggaccgtacggtacggggtccgtaggacgtaacgacgttacgtttaccgacccttactaccaacctactccgaacgcgtaccgtccgtgcgagacgtaggaacgtagttgggtacgtagttaacgttttactacgttagtacgtagtacttaaagttaacttagtaacggtacttacccgttacgtaagggttaccgtttacgggggacccgggtaacgacgttggtaacgggaataccggtaaacgtaaaccggtactgggttaactcgtaacaccggtaaccttaggttacccttaggttcctttccgttacccgttacccg

SEQ ID NO: 3866 - DNA, 786 bp, Homo sapiens
  misc_feature: GYAE6OF01B3QA8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggattctctggtgccgtacggggacattcgtgatcgaccctagtcctccagacctcccgtggtctgtgtcctcgtgggcgaggacggaccacctactacaactcgacgagtccacgccgtagtacgttacgtttacacgtacggtaccaaactaataacgtaattactcgtacgttacggaccagtacaacgaaaccgaggacaccgtcctaccgtaagttcgtctacttagttacgcggtactacgttcccggtacccgggtccgggttaccccggggtcctacggtacccgtacgttaccggacggaccggcggtaacgggtcggtaccgtaggaacgtacgtaacgttaccttacctaccgttccaaccgtacccgtacgtaaccggacgtacccggtccgtcgtacgacggacggtacgtaggaacgtcggtcggtacgttacgtttacgtttacgtttacgtacgtacgtacggtacgtaacgttaatttacgtacggttacctaccgttacggtacgtttaccggggttaccggggtacccgggtaaccggacggtacggtaacgggtaactaacgtaaaccgtaaacggttcggtacggtaccggtaccgtacccgtaaaccgtccgttaaaccggtctttaacccgttcttaaccccgtcccgtttaccccg

SEQ ID NO: 3867 - DNA, 841 bp, Homo sapiens
  misc_feature: GYAE6OF01A5RMS.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgaggacgggcccaccatcaactgacaagtccagccagtagttgtttacacgtacggtaccaaactaaagtaagtaactttacttccgtcgtttacggtaacccaagaccaaacgaaaacccgagggacctacgtacccttaaccgttaagttcgtaccttactaacgtttacggtcgggacctacgttacccggtaaccccgggggtcggttaccccgggggttccctacggtaacccgtactttccggacggtccgggacgtacgggtccggggtacgtaggaacgtaaccgtaggttaaccttttcccgaaccctttacctaacccgtaacctaacgttaccgaacgtacccgaacgtcccgttacggaccgtaacgggtaccgtaaggtaaaggtacggtttagggtacggttaaccttttaaggttttaaccgttacggttacggtaacgtacgtaacgtttaagtttaaccgtttaagttacggttaaccgttaccgttaccggttaacggtttacccgggtttaccggggaacccggggtaaccctaaggtcggtaggtaaacgtaccgttaaaccggaaaccggtcgttagggtacggccgttacggaacctaccgttacgttcgttaaccgttccttaaccgttccgttcccccg

SEQ ID NO: 3868 - DNA, 864 bp, Homo sapiens
  misc_feature: GYAE6OF01A7RAL.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtgatcgacccagtcctccagacctcccgtggctgtgtctcgtgggcgagcggcccacatcaactgacaacgtccagccagtagttcgtttacacgtacggtaccaaacaagtaacgtaatttaccttcggtacgtttacggtaccaggacaaacgtaaaccgaggaccacgtacccttacgttaagttcgacttactagtttcgcggactacgtccggtacccgggcggttccccgggtcctacggaccgtattccgacggccggacgacggtccgggtactacggaacgtaacggtacgttactttacccgaccgttacctaacctacctaacggtaccaacggtaccgtacgttacccggacggaccggtaacggtaccgtaaggggtaagttaaccgttcggggttaacggttaaaccgttttaacggtttttaactaaccggtttcggtaacccgttaacggttaacccgtttaagggtttttaaacccttaagggtttaaacccggttacccgttaccccgggtttaaccggttaaaccggggtttttaccggggtttaacccggggggggaaacccggtaacccggtaagggttccgggtaaacgggtaaggtaaaccccgttaaaacccggtaacgggtacgtttcccggggacgttacccgtactacccggtaaccgttcttacggttacccttttcgggtaaccttcccggttacccccg

SEQ ID NO: 3869 - DNA, 999 bp, Homo sapiens
  misc_feature: GYAE6OF01A6SHS.39.31.C09.1.454.CMB.1.raw
tcagtcgcactagtcacgaccggtgctcgatttagacgtctcatcaaggaaggaaggggcagcaagatggtgttgcagaccaggtcttcatttctctgttcgctctggacttctacgtgggtcgccgtacggggacatcgtagacgtcggaaccctacgttcctaccgtaacggtaccttcccgtcgggtcttcggtcgttccgtcggtcggggcgaacggaccgggacccaacgtactaccaagtcgacgacgtaccacgacgtaagtcggtttacgtttaaccaacgtaaccggtaacctaaaactaaacgttaacgttaacgtttaccgttacggtacggttttaccggaaccgacggaaccggtaaaccggtaaaaccggtacggtaccgtaccggttacctttaacgtttaaacggttcggttaccttagttaaccggttttacgggccggtaccgttacggttaccccgggtaacccggggttcgggttacccggtaccgtacgtaccgttaacggttccgaacgggtcggtaccgtacggtaccgtacgtaacggaacgtaacgttacgttacgttacccgtacgttaacctcccgtaaactcggtaaccgtacgtacgtaccgggtaccttacgggaccggttacgtaaccggtaaggtacgtttacggtagttacgggttaactttacggtttacgtaacgttccggttaacggaaacgtttaccgtttaaggtttaacgtacggttaaccgtcgggtttaaccctacgggtttaacccgggttacggggtacccggggtaaacccgttaggaaccggggtttacgtaagggttaaaacccgttaccggggaaaaacgtttccgggtaacggggttaaccgttaaccccggggacgtttttaaaccccgggtaacgttacgttttaaaccccgttaccccggggttttaccgtaacttttcccgggggttaaacccctttaaccccccgg

SEQ ID NO: 3870 - DNA, 784 bp, Homo sapiens
  misc_feature: GYAE6OF01DXN0J.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacagtcgtgatcgacccagtctccacgacctcccgtggctgtgtctcgtggcgaggacggccaccataccaactgaccaacgtaccgacgaccgtaaggtaggtttacgttttaaccaacgtaacggtaaccaaaactaaagtaaagttaactttaacgttccgtcgttacggtaaccacggaccaacgaaaccgtaggaccaccgtacctaccgttacgttctcctacttagtttaccgtggctacgttcccggtaccggtaccggtcccgggtcctacgaccgtcgtacgacggcgacgtacgggtccggtctacggtaacgacgtagttacctttacccaccttacccgtaccacccgtatccgaaccggtcctacgtaccggtcgtacggacggtacgtagaagttgtacggtacgttacgttttaacgtttacgttacgtacgtacgtacggtagtttaacgttaattacgtttaaccgtccgttaaccgttacggtaaccgggtttacgggtttaccgggacccgggttaaacgtacgtacgtacggaacgttaccgtaaacgtaaaccggtcggttacggtggtacccgtaccgtaactacccgtttacttcccgttactttacccgttacgtaccccggtttaccccg

SEQ ID NO: 3871 - DNA, 902 bp, Homo sapiens
  misc_feature: GYAE6OF01DRYXP.39.31.C09.1.454.CMB.1.raw
  modified_base (800)..(800): a, c, t, g, unknown or other
  misc_feature (800)..(800): n is a, c, g, or t
tcagtcgcactagtcacgaccggtgctcgatttagacgtctcatcaaggaaggaaggggcagcaagatggtgttgcagacccaggtcttcattctctgttgctctggatctctggtgcctacgggacatcgtgatcgacccagtctccagacctccctggctgtgtctcgtgggcgagacgggccaccactccaactgacaacgtcccacgaccaggtacgttcgttttaaccacgtacggtaccaaaacgaaactaaaggtaactttaaccttcgtccgtttaggtaacccgaagaccaacgaaaacccgacgggaccacgtcccttaccgtaaacgtttcgtaccttccgtaagttttaaccgtcggggtaacctaccgttacccggttaacccccgggggtaacgggttccccgggggtaccccgttacggaacccgttacgttaccgacggtaccgggaccgtaaccgggccggggtttaccgttacggaacggtaaacccttaagttaccgttttaccctaaacccggtttcccgttaacccaaccccgttaaacgttaccccgaaaggaccccgttaaccggttccccgagggtccccgtaacgggtacggttaaccggtaaaaggttacgttagggttaccggttaacgtttaaggtttttaacttaaccggttacgaccggttaagttacgtaaaggtttaactttaacgttaacggttaacctccgtttaacgtaggttttacccgggtttacgggggaccccgggttaacacgggtacgtaccgggtaanaaccgttaacgaaaacccgttacggttacggcggtaccctacggtacccctaaccgttcgttacccgtttagttaaccccttcgtccctttaaccccccggg

SEQ ID NO: 3872 - DNA, 801 bp, Homo sapiens
  misc_feature: GYAE6OF01C397H.39.31.C09.1.454.CMB.1.raw
  modified_base (317)..(317): a, c, t, g, unknown or other
  misc_feature (317)..(317): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgaggagggcccaccataccaactgacaacgtccagccagtagttgtttacacgaggtaccaaactaagtaagtaattacgttcgtcttaggtaaccagacgaaacgaaacctaggaccacgtaccctacctaaggttcnctctaacttttacggcggactacgtccggtaccccggggtacggtccccggggttacctacgaaccgtacttacggacggaccggtacgacgggtccggggtctaacggaacgtaacgtaacggttacttttaccaccgttacctaccgaacctaacgtaccgaacgaccgtaccgtcccgtacggaccgtacgggtaccgttaaggtaaacggtaacgtttcgggttaccgggttacgtttaacggtttttaacgtttaaacgtcggttaacgtaacggtaacgtttaaacgtttaacgtttaacgtttaacggttaccgtttacccgttaacggttaacgggtttaccgggttttaccggggacccggggttaaaccgtacgggacggttaacgggtaacgtaacgtaaaccgtaaacgtacggttaggtacggtcgtacgtacctacgttacttcgttcgttaccttcgtccgttaccccg

SEQ ID NO: 3873 - DNA, 683 bp, Homo sapiens
  misc_feature: GYAE6OF01AW9AQ.39.31.C09.1.454.CMB.1.raw
  modified_base (158)..(158): a, c, t, g, unknown or other
  misc_feature (158)..(158): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatgacccagtctccagactcccnggctgtgtctcgtgggcgagagggccaccatcaacgtgacaagtccagccagtagtgtttacacgagtaccaaacgaataagtaattactcgtcttacggacagacaagaaccaggacacgcctacgtaatcgctactattacgtcggacacttaccgtaaccggggtacgttcccggggtacctacggtaacccgtacttaccggaaggtccgggaccgttaacgggcccgggtttaacgtaccggaaacggtaacgtaacggtaacttttacccaacttcgtaaccctaaccgtataccgaacgcacggtctagacgtacggactaggtaagtacgtggtacggactttagttaacttacgtacgtacgtacggactaagtttaattaacgttaacggtacgttacctagtacgttacgtttacggggaccgggtaacacggtgacggagtagttaaacgaacggtacgtggtacgtacgtacgaccgaacgtacttacgtacttacttccgtagttaccccg

SEQ ID NO: 3874 - DNA, 769 bp, Homo sapiens
  misc_feature: GYAE6OF01C60E5.39.31.C09.1.454.CMB.1.raw
  modified_base (333)..(333): a, c, t, g, unknown or other
  misc_feature (333)..(333): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtgatcgacccagtctccagactccctggctgtgtctcgtgggacgaggagggcccaccactacaactgaccaacgtccacgaccgagtagttacgttttacacgtacggtaccaacgaataagtaacttacttcgtacgttacggtaccagacaacgaaccgagacacgtacctactaagtcgcctactactttacgnggactacgtaccgtacccggggtacggtcccgggttaccctacggaccgtattaccgacgtccggacgtacggtcggtacgtacggacgtaacgaacggttcttacgtaccgtactacccaaccgtacgtacctaacggccgtaacgtccgtacaccggtaggtccgttaaggaacgttaggttcggtacgggtacctttaaggttttacccgttacgttacggtaaccgtacgtaatttaacgtttaacgtttaaacgttacggttacccgtttacccgttacgggtaccggttttaccgggtttaccgggggaaccgggtaaccctagggtaccgtaggtaaccggtaccgtaaccggtaaacgtacggttcggtacggtctaccggaccctacgttaacctcgttacggtttacctcgttaccccgtaccccg

SEQ ID NO: 3875 - DNA, 911 bp, Homo sapiens
  misc_feature: GYAE6OF01BKV59.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagacggccacatcaactgacaacgtccagccagtagttcgtttacacgtacgtaccaaactaataagtaactttacttcgtcgttacggtaccagacgaaacgaaaccgaggacacgtcctaccttaagttcgcttacgtagtttacggtggacctacgttaccggtacccggggtacggttccccggggttcccgtacggaccgttattaccgacggtcccggcgacgggtccggggtacgtacggaacgtaccgtaacgtttacttacccgttaccgttacccttacccgaaacccttacgttaaccacggtaccgttaccggacccgttcggaaccggtaccggggttacgtaaaggggttaaccgttagggtttaccgggttacgggtttaaccgtttttaacggggttttttaaccttacccgggtttagttaaccggtaacggttaaacgggttttaagtttttaacccggtttaaaggttaaccggttttaccggtttaccccgtttaaccggttaaccggggttttttaacccggggttacccgggggggtaaaccccgggaaacccgttagggttaacgggtaccggtaacggtaaaacccggtttaacccggtaaaaaccggggttcgttcggggttaaccgaccgtttacccgggtaacccttaaacgggttccccgtttagtttacccgttcgttttaaccccgtcccggttttaccccccg

SEQ ID NO: 3876 - DNA, 646 bp, Homo sapiens
  misc_feature: GYAE6OF01D3XGH.39.31.C09.1.454.CMB.1.raw
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (439)..(439): a, c, t, g, unknown or other
  misc_feature (439)..(439): n is a, c, g, or t
  modified_base (579)..(579): a, c, t, g, unknown or other
  misc_feature (579)..(579): n is a, c, g, or t
  modified_base (607)..(607): a, c, t, g, unknown or other
  misc_feature (607)..(607): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtctccagacctcccgtggctgtgtctcgtggcgagacggccaccatacaactgacaacgtccacgccagtagttgtttacacgacggtaccaacaaagtaaagtaactttacgttccgtcgttacggtaccagacaaacgaaaccgacgaacaccgtaccttaccgttaagttcgtctacttacgtttacgtacggctaacgtccgtaccggggtccggttcccgggtaccctcggaacctacgtcgacggccggcgnggtcggtcncganactacgtctttcacctctacacnacgacgctacgcctgacgcgtagagtaacgtgttacggcttacgttaagtttccgttagtcgtaccgagtacttaatttacgttagtacggttacctctaacggtagttccgggttacgggacggaccaggtaccggtanaagtactaacggaacgtctgggtcctanaccgccgtaaacttgtacctttagcttactacgttcccc

SEQ ID NO: 3877 - DNA, 734 bp, Homo sapiens
  misc_feature: GYAE6OF01DZE22.39.31.C09.1.454.CMB.1.raw
  modified_base (704)..(704): a, c, t, g, unknown or other
  misc_feature (704)..(704): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctaccagacctcccgtggctgtgtctcgtgggcgaggacgggcccaccactacaactggacaacgtccagccaggtagttcgttttaacacgtacggtaccaaactaagtaaagtaacttacttccgtacgttacggtaccagactaacgaaaaccgaggaaccacggtcccttaccgttaaggttcgtaccttactaacttttaccggtcggggactaccgttacccggtaaccccgggggccggttaccccgggggtccctacggtacccgtacttccgacggtccggcgacgggtccgggtagtacggaacggtaactaggttactttacgaaccttcctaaccgaactctacgacgtccgaacgtcccgtgacgtacggtctaagaagtcgtggtgtaccgttaagttttactaaccgtgtaccagtccgtaagttacttagtacgttccgtaccgtacgtacggtttccggtttaccggggaccgggtaacctacgcgtaggactacgtaacgtaaccggtgtacggtcggtacgtacgacccttaccgtnttccgtatttcccttacgtcccttccccgg

SEQ ID NO: 3878 - DNA, 765 bp, Homo sapiens
  misc_feature: GYAE6OF01DX6XD.39.31.C09.1.454.CMB.1.raw
tcagtcgcactagtcacgaccggtgctcgatttagacgtctcatcaaggaaggaagggcagcaagagtggtgttgcagacccaggtcttcatttctcctgttgctctggatctctggtgcctacgggacactcgtcgatcgacccagtctccagactcccgtggctgtcgtctcgtgggcgagacggccacatcaactgctaacgtccagccgaagtacgttcgtttaccacgtacggtaccaaaacgtaactaaagtaactttacgttccgacgttacggtacgacgtacgaacgtaacgaggtacacgtaccgtacgtacgtcgtacctacgtacgtttacgtcggtactacgtacccggtacccggtaccggtccgggtaccgtacgtaaccgttacgtaccgcggtaccggaccgtacggtaccggtacgtacggacgtacgtacgttacgtacctaccgtaccgtaccgtaacgtacgtacgtaccgaccgtaccgtccgtcgtacgtacggtacgtacggtaacggtacgttcggtaccgttacgttaaccgtttactacggttacgtacgtacggtacttaacggttaacgttacgtacgtaccgttacgtacggttacggttaccggttaccgggaaccgggtaccgtacggtaccggttaacggtaaccgtacgtaaaccgtaaccggttacggtacgtacggaacgtaccgtccgtaacgttcgttacggttaaccgttccttccgtacccgtcg

SEQ ID NO: 3879 - DNA, 781 bp, Homo sapiens
  misc_feature: GYAE6OF01AG7MM.39.31.C09.1.454.CMB.1.raw
  modified_base (357)..(357): a, c, t, g, unknown or other
  misc_feature (357)..(357): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccacgacctcccgtggctgtgtctgtgggcgaggacggccacatacactgacaacgtccagccaagtagttcgttttaaccacgacggtaaccaaataaacttaaagtaaacttttaccgttcgtacgtttacggtaacccaaggaccaacggaaaccgacgggaaccaccgtaccttaccgttaacgtcgtacttactacgtttacgnggtacctacgttacccggtacccggggtacgggttcccggggtaccctacggacccgtagttaccgacggacggtcgtacgggttccggttacgtaggacgacgtacgttactttaccactctaccaccatacgacgcgtacgccgtaacggacggtacggtacgtaggaaacgttggtacggtacggttaaccgttttaaagttttacgtttacggtacgtaaccgaggtaccgtttaagtttaagtttaacggttacggtttacctaccgttacggttaacgggtttccgggtttaccggggaacccgggaacgtaacggtgtaagggaacttaaacggaccaaaacgggttccgtagggtacgtcgacccgtaacccttacgtaccgttccgttaccgttaccttccgttcccgttacccc

SEQ ID NO: 3880 - DNA, 758 bp, Homo sapiens
  misc_feature: GYAE6OF01CUWW0.39.31.C09.1.454.CMB.1.raw
  modified_base (192)..(192): a, c, t, g, unknown or other
  misc_feature (192)..(192): n is a, c, g, or t
  modified_base (440)..(440): a, c, t, g, unknown or other
  misc_feature (440)..(440): n is a, c, g, or t
  modified_base (468)..(468): a, c, t, g, unknown or other
  misc_feature (468)..(468): n is a, c, g, or t
  modified_base (491)..(491): a, c, t, g, unknown or other
  misc_feature (491)..(491): n is a, c, g, or t
  modified_base (560)..(560): a, c, t, g, unknown or other
  misc_feature (560)..(560): n is a, c, g, or t
tcagtcgcactagtcacgaccggtgctcgatttagacgtctcatcaaggaaggaaggggcagcaagatggtgttgcagacccaggtcttcatttctctgttgctctggattctcgtgggtcgacccggtacggggacagttcggtgactccgaacccctagtcctccaagccctcccgtggctgtgtctggnggcgaggcggccacataccactgactaacgccagcgagttagtttcgtttaaccaacgtacggtaacccaaataaagttaaagtactttaccgttcggtacgtttacggaccagaaccaaacggaaaccgaggacctaccgtccctttaacgttaaggttcaccttacgttaagtttcggacggtacctaccggttaccccgggtaacccgggtccgggttaccccgggttccctaacgacccgttanccggacgggcgacgtacggtcgggttanaggaagactaagtttccttaccnccgtactaccgaactgcgtacgcctacgctcggacgaggactaggaagtgtggtacgtatttaacgttnttaccgtgaccgaagttacgttatttaacgttaaggtgttacccgttacgtacggttaaccgggtttcccgggttaaccggggaacccgggtaacgtaggttaccggaagtaaaccggtactaaaccggaaaccggttgtcgggtacgtccctaccgaccctacgttacgttcgtcttacccttcgtacccttccccg

SEQ ID NO: 3881 - DNA, 805 bp, Homo sapiens
  misc_feature: GYAE6OF01EPRAW.39.31.C09.1.454.CMB.1.raw
tcagtcgcactagtcacgaccggtgctcgatttagacgtctcatcaaggaaggaagggggcagcaagatggtgttgcagacccaggtcttcatttctctgttgctctggatctctggtgccgtacggggacatcgtgatgacccagtctccagactccctggctgtgtctcgtgggcgaggagggccaccatcaactgcaagtccagccagagttgtttacacaggtaccaacaataagaattacttcgcgttggtaccagacaacgaaaccgagacacgtcctaccgtaagttcgcctacgtatttacggtgggactacgtaccggtacccgggtaggttccccggggtccctacggtaccgagttcgaggccggacgacggcggggtctaggacgtacgtaagtactttcaacttcctacctaccacttcaacgccacggtcccgttgaccgtacgggaccgtaagggaaacggttcgtagggttccgggtaacgtttaaaggtttttaaccgtttacggttacggtaccgtacggtaccgttaaggtttaacgttttaacggttaacggttaccggtttacccgttaacggttaacccgggtttaacggggtttttacccgggggaaccccggggggttaaaccaacgggttcggtaaaccggggtaacgttaaccggttaaaaccggttaaaacccgggtaacggttagggtacggtacccggttaaccggaccccgttaaacccggttctttacccgtttaccggtttaccctttaccggtttaacccgtttacccccgg

SEQ ID NO: 3882 - DNA, 900 bp, Homo sapiens
  misc_feature: GYAE6OF01BEFHK.39.31.C09.1.454.CMB.1.raw
  modified_base (348)..(348): a, c, t, g, unknown or other
  misc_feature (348)..(348): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgaccagtctccagacctcccgtggctgtcgtctcgtgggcgaggacgggccaccatacaactgacaacgtccagccagtagttagttttacaacgtacggtaccaaactaaataaagtaactttacttcgtacgttacggtaaccagacgaaacggaaaccgaggaacacgtaccttaccgttaagttcggtcttacgtacgtttacgnggtacctacgtacccggtacccggggtacggttccccggggttacccgtaggtacccgtacgttaccggacggccgggtacgtacgggtccgggttacgtaggaacggaacgtacggttactttaccgtaaccttacctaccgtaacctacgtaaccgacgtaccgtaccggtcccgttaggaaccgaacgggtctaaacggaaacggttcggtacgggtaacgggttaacccttttaaggtttttaaccgtaccggtttacgggaaccgttaacgggtaaactttaacggttttaaactttaacgtttacggttaaccgtttaaccgttaccggttaacggggtttttacccggggtttaaccggggggaacccccggggttaacaaccggggtttccggaaacgggttaaacccggtaaccgttaaaacccgggtaaaacgggtacccggtttagggttacggtaacccgttaccgtaaaccccgtaacggttttaacctttccgggtttaaacttttccccgttaacgttacccccgtttaacccccgg

SEQ ID NO: 3883 - DNA, 869 bp, Homo sapiens
  misc_feature: GYAE6OF01EISWN.39.31.C09.1.454.CMB.1.raw
tcagtcgcactagtcacgaccggtgctcgatttagacgtctcatcaaggaaggaaggggcagcaagatggtgttgcagacccaggtcttcatttctctgtgctctggatctctggtgccgtacgggacatcgtgatcgaccagtctccagtacctcctggtctgtgtctcgtgggacgacggacggaccacactacaactgacacgtccacgcagtagttagtttacacgtacgtaccaaataaataagtaactttacttcgtacgttacgtaccacgacgaaacgaaaccgaggaaccaccgtaccttaccgttaaggttcgtaccttacgttacgtttacggtcgggacctacgttaccccggtaacccggggttacccggtcccggggtacctaccggtaccgttataccggacggaccggtacgtacgggtccggtacgtaggaacgtaacgtaacgttcgtttaccctacgttcctacgtaacccgtaagttccggaccggtacctacccggtacccgtcggtaacggtaccggtaacggtaagggtaaaccgtttggtaacggttacggtttaaccgtttaactttttaaccggtaccgttagtacccggtaagttaaccgtttagttttaacgtttaacgtaacggttccttaccgggttacgttaacggggtttacccggggtttaccgggggaacccgggtaaacttacggggtccggttaaacgggtaaaccgttaccgggtaaaacccgaacggtttaccggggtaacgggttccggtaaacccggtcctaacccggtaaccgtttcgggtttaccccgttaaccctttaacctttcccggcccccgttttaccccgg

SEQ ID NO: 3884 - DNA, 859 bp, Homo sapiens
  misc_feature: GYAE6OF01DQNI4.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtctccagacctcccgtggctgtgtctcgtggcgaggacggccaccatacaactgacgaagtccagccagtagttcgtttaacacgacggtaccaaactaaagtaacgtaactttactcgtcgttacgtaaccctagaccgaacgaaaaacccagggaacctaacggtacccgtaaccgttaaacggttcgacttccgttaaagttttaccggaccgggtacgtacccgtttacccgggtacccccggggggtacggtttccccccggggggtacccttaaccggggtaccccgtaaacgttccgggaacggcccgggacgtaacggggtccgggtccttagggaacgtaactaaggttaccttttaccgacccttctacccaacctacgttacaacccgctaccggaccttcgaacggacggtacgttaggaaaacggtgtttacggacgggttaactttaaggtttttactaacgtttcgggtaccgaagtacgttaaacggtttaattttaacgtaacggtttaaccgttccgttaaacggttaccgggttttaaccgggtttccggggggaaacccggggtaaccgtacgggttaccggtaagggtaaaccgtaccggttaaaccgtaaaccgggtaaggttccggttacgggacgttaccgtaccgtaaccgaacttttcgtacggtttccccttcgtccgttacccccg

SEQ ID NO: 3885 - DNA, 875 bp, Homo sapiens
  misc_feature: GYAE6OF01EKNZD.39.31.C09.1.454.CMB.1.raw
tcagtcgcactagtcacgaccggtgctcgatttagacgtctcatcaaggaaggaaggggcagcaagatggtgttgcagacccaggtcttcatttctcttgttgctctgactctcgtggtcgccgtacgggacagtcgtgatcgaccctagtcctccagtacctcccgtggcttgtcgtctcggtgggcgaggacggaccacataccaacgtcgacgtaaccgtccacgaccgtaggttacggtttacgttttaaccgaccgtaacggtaaccctaaaagtaaaacgttaaagttaaacttttaccggttaccgttaccgtttacgggtaacccaacggtaccgaaaaccggaaacccggaacggtaaccgtacccgttaaccctttaaccgttaacggttccgttacccttacgtttaacgttttaccggcgggtaaccttaccggttaccccgggggttaaccccggggtacccggggttaccccgggttacccggtaccggtaacccgttacgttaccgggaacgggtccggggaccgtaccgggtccggggttactaacgggaacccgtagtaacgttacgtttacctacctaccgtactaccgtacaccggacgaccgacgtccgacgtaccggtacgtcgtaaggtagttgtggttacggtacgtttaactttacgttagtcgtacgtaggtacttaagttaattacgtaacgttcgtaccgtacggttacggttaccggtttaccgggaacgggtaaccgtacggtaggtacggaacgttaccgtaaacggtaaccggttacggttacggcggtacctcccgtacctaccgttacttcccgttaacgtcctttccgtacccgttacccg

SEQ ID NO: 3886 - DNA, 818 bp, Homo sapiens
  misc_feature: GYAE6OF01A12SF.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggacgggccaccatccaactgacaagtccagccagtagttgtttacactaggtaccaaacaataagtaacttacttcgacttcggtaccagacaacgaaaccgaggacacgtaccctacttaacggttcgcctactaagtttaccgtgggtactacgtaccggtacccggggacggtcccggggtaccctacggacctacgttcgacggcggacgacggcgggtacgtacggaacgacgtaagtacgtttacctaccttccgtacctacctactaccgacgtaccgacgtcccgtaggaccgacggtccgtaagaacggtagtacgggtacggtactttagtttaacgttacgtcgtacgtacgtacgttaagtttaacgttaacgtttaacggtaccgttacccgttaacgttaccgggtttaccgggttttaccgggggaacccggggttaacccggtaacgggttacggtaacggggtaaaccgtaaacggttaaacccggtaaaaccgggttaccggtttacggggttaccgggtaacccggttacccgtaaccccggtaaaccctttaaccggtttaccccgtttaacggttttaaccccttaaccccggtttaccccgttttaacccccccgg

SEQ ID NO: 3887 - DNA, 865 bp, Homo sapiens
  misc_feature: GYAE6OF01BIGGZ.39.31.C09.1.454.CMB.1.raw
  modified_base (592)..(592): a, c, t, g, unknown or other
  misc_feature (592)..(592): n is a, c, g, or t
  modified_base (598)..(598): a, c, t, g, unknown or other
  misc_feature (598)..(598): n is a, c, g, or t
  modified_base (605)..(605): a, c, t, g, unknown or other
  misc_feature (605)..(605): n is a, c, g, or t
  modified_base (669)..(669): a, c, t, g, unknown or other
  misc_feature (669)..(669): n is a, c, g, or t
tcagtcgcactagtcacgaccggtgctcgatttagacgtctcatcaaggaaggaaggggcagcaagatggtgttgcagacccaggtcttcatttctctgttgctcgtggatctcgtggtcgccggtacgggacatcggtgatcgacccagtcctaccgaacgtcctcccgtggtcttgtcgtccgtcggtcgggacgaaggaccggacccaaccgtactaccaacgtcgaccaacggtacccacgaccgtaagttacggtttacgtttaacgaccgtaaccggtaaccaaaacgtaaagttaacgtaaacttttccgttcgtaccgtttaacggaacccgaacgaccgaaaacggtaaaacccggaaggaacctaacccggtaccctttaacggttaaacggttccgtaccgttaacgttaaccggttttacggtcggggaacccttacccggttaaccccgggttacccgggggttacccgggttccccggggttacccgtaacggtaacccgttacgtacggaccggtccgggtacgacgggtccggtacgtaggaacgtactacgttactaccgtacctacaccgtacncgtacncggtacncgtcgtagaccgagtacgaggtaagtcggtgttaccggtatttacgtttaactacgtacggtanaccggtttattaaacgtttagtaacgttacgtccgttaacgtaccggttaaccgggtttaccgggtacggggacccgtaacggtacgtacggtaggtaacgtaccgtaaaccgggtactaacgggttcgtacggacgttccctaaccgttacgtcgtttaccccggtagtttacccgtccgtttaccccgtacccg

SEQ ID NO: 3888 - DNA, 941 bp, Homo sapiens
  misc_feature: GYAE6OF01ELXDY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacagttcggtgatcgacccagttcctccagacctccctggcttgtgttctcgtgggcgaaggacgggccaacactacaactcgacaacgtccaagccgagtagttcgtttacacgtacgtaccaaacaaagttaaacgtaactttaccgttcgcgttacggtaaccaaggtaccaaacggtaaaccaacggacccaacggtaccctttaccgttaaaggtttccgacttaccgtttaacttttaccggccgggactaacggtttcccggtaacccccggggggttacggttacccccgggggtcccttacccgggaaccgttaaccgttaccggacgggtacccgggtacgtaaccggggtccgggttactaagggtaacgaccgttaacgtttaacttttacccgtaacttcccgtaacccttaaccgaacggttaccaaggtacccgtacggcccttacgggaccgaaaggggtcccgtaaaggggtaaaacgtttaccggttacgggtttaacgggtaccgtttaaacggtttttaaccgtttaccggttacgttaacgtaggtaacctttaagttttaacggtttaaaggttaaccggttaaccgtttacccgttaacgttttaaccgggttaaccggggtttttaacccggggaaccccgggggtaacgtaaccgggttccggttaaggggtaaacgttaaaccggttaaaacccgtaaaacgggtaacccgttagggtacccggttaccgtaaccgtcccgtaaacttaccgtacggtttacgttctttaacccgtcgttaaccccg

SEQ ID NO: 3889 - DNA, 1061 bp, Homo sapiens
  misc_feature: GYAE6OF01DDKH7.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatacgaccctagtctccagtacctcccgtggctgtctctcgtgggacgaggacggccacactacaactgacaacgtccacgaccagtagttcgttttaacacgtacgtaaccaaactaaagtaaacgtaaactttacgttccgtacgtttacggtaacccganaccgaaacggaaaacctagggaaccacgtacccttacgttaaacgttctaccttacctaagttttaccggtcgggtacgtaaccgtttccccgggtaaaccccgggggtaccggggtttacccccggggttacccttacccgggtaacccggttacgttacggaacccggccggggtaccggtacgggtacccggggtcgtttacggaaacggtaaccggtaacgtttactttaacctacccgtttacccggtaacccaaccgttaacgttaccggaaacctaccggtaaccgtcccgggttacggaccggaccgggttaacgtaaacggtaaacggttaaacggttacggggtacgggtttaaacgtttaacggtttttaaccgtttaccggttacgtttaacggaaaccgttttaacgggtttaaacggtttaaactttttaaacggtttaccggtttaaaccgttttaaccccgggttaaacccgggttttaaacggttttcccgggggtttttaaaccccgggggggacccggggggttaaacccgttaacgggttaccgggtaaaacgggggttaacccgtaaaacgggttaaaaccccggttaaaaacccgggttaaaacggggtttcccggggttaaaccggggtccccgttaaaaacccgggtaccccttaaaccccggttttaacccggttttaacccgtttacccgtttacccgttttaacccccgttaccgggttttaaacccccccccggg

SEQ ID NO: 3890 - DNA, 789 bp, Homo sapiens
  misc_feature: GYAE6OF01CNM09.39.31.C09.1.454.CMB.1.raw
  modified_base (177)..(177): a, c, t, g, unknown or other
  misc_feature (177)..(177): n is a, c, g, or t
  modified_base (481)..(481): a, c, t, g, unknown or other
  misc_feature (481)..(481): n is a, c, g, or t
  modified_base (749)..(749): a, c, t, g, unknown or other
  misc_feature (749)..(749): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacagtcgtgatcgacccagtcctccagcctcccgtggctgtcgtctcgngggcgaggacggacccacactacaacgtcgacaacgtccacgacctagtagtttacgtttaacacgtacggtaaccaaaactaaataaacggtaactttaccgttcgtacgttacggaaccacgaacaaacgaaaccgacggacaccgtaccttaccgtaagttccgtactacgttacgtttaccggacggtaccgtaccgttacccggtacccggggtacgggttccccgggtaccctacggaccgttacgtccggacggcggtaccgagggtccggtacgagaacgacgtacgtctttaccncctctacgacctgcacgctacgcgtagacgtacggtagaggaactggttaccggtaggttaacctttaagtttaccgtagtacccggtagaagttaacgttaacggttttaatacgggttaacgttccggttaacttacgggttaaccgggtttaccggggtacccggggaaccggtaccttagggaacccggttaaggtaacccgtaacgtaaaccggaaccggttacggtgttaccggtaacctcccgtaacccgtagtttaaccncgttttaacccggttcccaaccctttccggttaccccccg

SEQ ID NO: 3891 - DNA, 620 bp, Homo sapiens
  misc_feature: GYAE6OF01BEWB8.39.31.C09.1.454.CMB.1.raw
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (611)..(611): a, c, t, g, unknown or other
  misc_feature (611)..(611): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgacaagtccagccagtagttgtttacacgaggtaccaaacaaataagtaacttacttcgtcttaggtaccagacaagaaaccaggacacgcctactaagttcgactactattactgggactacgtaccgtacccggggacggtcccggggtcctacggtaccgtattcgacggcggactacgggccggtactggaacgacgtagtactttccacgttctaccactancgtancacgtctacgacacggtcgtagaagtagtggtagtacgttagtttattactacgtatacgtactagttaattacgtagttaccgtacctgtacgttacgggtttacgggacccggtaacgtacggtcgtaggtagtactaccgaaacgtacgtgacgtcgacgactacgtactcgttatcttntccgttccg

SEQ ID NO: 3892 - DNA, 863 bp, Homo sapiens
  misc_feature: GYAE6OF01DIWT6.39.31.C09.1.454.CMB.1.raw
  modified_base (585)..(585): a, c, t, g, unknown or other
  misc_feature (585)..(585): n is a, c, g, or t
  modified_base (602)..(602): a, c, t, g, unknown or other
  misc_feature (602)..(602): n is a, c, g, or t
tcagtcgcactagtcacgaccggtgctcgatttagacgtctcatcaaggaaggaaggggcagcaagatggtgttgcagacccaggtcttcattctctgttgctctggatctcgtggtcgtccgtacggggatacgtcggtagacgtcggaaccctaggttcctaccaggtaccctcccgtggtcttggtcgttccgtcggtcggggacggaggacgggtcccaacctacgtaccgaaaccgtcgaccggtaaccgtaccgacggtaccgtaaggttacggtttacgtttaaccgaaccgtacggtaaccaaaacgtaaagttaaaacggttaacttaccgttccggtacgtttaccggaaccgaacggaaccaaaccgggaaaaccgaacggggacctaaccgttacccgttaaccggtaaggttccgtccttactttaacggtttacgggccgggtaactaccggtttaaccccggggtacccgggggtaccgggttcccggggtaccctaacggtaccgtagttccggacgggtccgacggtacggtccgggtacgaggtaacgtacgtagttcctttaaccncggttaccacgtaaccncgtacgaaccgacgtacccggtcgtacgacgtacgggtaacggtaacgtacgttacgttacgggttaacggttacgttttaaccgggtttacttaaccggtacgttaaccggtagtacgtttaaagtttacgtaacggtttaccggtaccttacgtacggtacggttacgggttaccggggaacgtacgacgtcgggtagaacgtacgaaaccgtagtcgtggtatccgcgtacacgttctacgtctccttcgccgttacc

SEQ ID NO: 3893 - DNA, 848 bp, Homo sapiens
  misc_feature: GYAE6OF01DXLQE.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccacatcaactgcaacgtccagaccagtagttcgttttaacacgtaggtaccaaactaaataaacgtaattaacctttcggtcgttacggtaaccacgtacaaacggtaaaacccgaaggtaaccaacggtcccttacccgttaaacggtttcggaccttaccgttaacgttttaaccgttacggggtaaccgtaacgtttacccggtaaccccgggggtaccgggtttccccgggggttacccgtacggtaacccgtaacgtttaccgacggtaccggccgtagggccggggttacgtacgggacgtaacgtacggttaacttttaccgtaaccttcctacccgtaaccgtaaccgtttaccggaacggtaccgtaaccggtcccgttaccggacgaaccggttaccggttaaccggaaaggtacggttcgggttacggtagttaaacgtttttaacgtttacgttcgttaacgaacggtacgttaagtttaaacgttacgtttaagtaaccggtttcctacggttagtttaaccgggtttcgggaacccggggttacctaagggtcgtaacggtaagtaaccgtaactaaacggtacgttacgggacggttcgaaccgtaccgtaccttactacgttccttacgttacctaccgtttacccccg

SEQ ID NO: 3894 - DNA, 768 bp, Homo sapiens
  misc_feature: GYAE6OF01BW74X.39.31.C09.1.454.CMB.1.raw
  modified_base (513)..(513): a, c, t, g, unknown or other
  misc_feature (513)..(513): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtgatcgacccagtcctccacgtacctcccgtggctgtcgtctcgtgggcgaggacgggcccaccataccaactgactaacgtccacgccaaggtagttacgtttaacacgacggtaccaaactaataaagtaactttaccgtcgtcttacgtaccagacaaacgaaccgaggacacgtacccttacgtaagttcgtctacgttaagtttcgacggtactacgtccccggtacccggggccgggttccccgggtccctaggaccgtacgttcgaccggcggccgtcggccgggttacgtagacggtacgtaacttacttaccgtaactcctacccgtaacctctacgtacgactaccggtactacgaccgggtaaccgngttaaggaacgtgttcgggtacgttactttaagttttacgtacgtcgaactaggttacgttaagtttactttaacggtacttacccggtttactacggtttaacggtttccgggggttaccggggaacggtaacgtacgtcggggttaaaggaacctacggtaaaccgttaaacggcgggttttcggacgtacccttaccgggtactaccctttacggtttctacccggtttaccttccgtcccctttaccccgg

SEQ ID NO: 3895 - DNA, 1117 bp, Homo sapiens
  misc_feature: GYAE6OF01AFCZ3.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctcgtggtcgaccgtacggggactacgtcgtgatcgacccagtcctccagacctccgtgcttgtctcgtcgtggcgagacggccaacatccaacgtgacaacggtccacgaccgaagttaggtttacgttttaaccacggtaacggtaaccaaaactaaaacgttaaaacgttaaacgttttaaccgttcgtacccggttttaaccgggtaacccaaacgggaacctaaaaaaccggaaaaccccggtacggggtaaacctaacccggtaaccctttaaccggttaaaacgtttccgttcccttaaaccgtttaacgttttaccggtaacgggaacctttaacccggtacccccggttaaaccccgggggttaccggggtttacccccgggtttacccgtaccgggttaaccccgtttaggtaaccggaccggggacccggtaacgggttaccgggtccggtacggtaacgggtaaaccgacgtttaacgttacccgtttaacctaacccggtaccgttaccaaacccgttaaaccttacgaaccggttaacccgacccgtttaccgtacgggaaccggtaccggttaagggttaaacgtaacggggttaacgggtttaacggggttacgtttaaaccgtttttaaaagggttttaccccgttttaaggtcccgggttttaaataaacccggttaggtttaaaagttttaaacccgggtttttaaacgttaaccggtttaacccgggttacctttaaacggggtttaacccgggttttaaccccgggggggttaccgggggtaaacccggttaaaaccgggttaacccgggttaccgggttaaaaccgggtaaagttaaaacccccggtaaaagttaaccccgggggttttaacgttacggggacccggttaacccgttaccgggaaaccccgtttaaacgtttaacccggtttttaacggttccctttttccccgttaaaacccgttccccgggtttaaacccccg

SEQ ID NO: 3896 - DNA, 708 bp, Homo sapiens
  misc_feature: GYAE6OF01BC3M0.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggacgggcccaaccagtccaacgtgacaacgtccagccagtagttcgtttacacgaggtaccaaacaataacgtaacttacgttcgtacttcggtaaccaggtacaacgaaaccgaggacacgcccttaccgttaagttcgccttactacgttttaccgcgggactaacgttcccggtaacccggggacggttcccggggtaccctaggtacccgtattccgacggtccggacgacgggtccggggtacttaggaacgaacgtacggtacttttccgaccttacgtaccaacctacgtacgaacgcgaccgtccgtcggaccgacggtacgtacgaaggtagtaggtacggtactttaaggtttattacgtgtacgtagtacgtaagttaattagtaacgttccgttaccttagtacggtttacggtttacggggacccgggtaacaggtcgtaacggaagtactaaaccggaaacgtacgttggacggtcgacgtacctacgtcttcgtacgttctacgtcgttaccccg

SEQ ID NO: 3897 - DNA, 1005 bp, Homo sapiens
  misc_feature: GYAE6OF01BGRDZ.39.31.C09.1.454.CMB.1.raw
  modified_base (351)..(351): a, c, t, g, unknown or other
  misc_feature (351)..(351): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccgtggctgtgtctcgtgggcgaggacgggccaccatcaactgcaacgtccagccagtagttgttttaacacgtacggtaccaaactaaattaaagtaactttaccgttcgtcgtttacggtaacccaggaccaaacgaaaacccgaggaacctacgtcccgttacgttaacggttcgaccccttagttttaccgnggggtacctacgttacccggtaaccccggggacggttccccggggtaccctacggaacccgttattaccgaggccgggacgtacgggtccggggttctacgggacgtaaccgacggtttactttaccgaacccgtttcctaaccaacccgtacgttaccgaacggtacccgaccggttaccccgttcggaaccgggtttaacccggggtaccgttaaggggtaaacgggtttacggggttacggggtttaaccgggttacccgttttaaacggttttttaaacccgtttaccggtttaccggggttaacccgtaacggggtttaacgtttaaccgggtttttaaattttaaaccgggtttaaccgggtttaacccggttttaccccgtttaacggtttaaccggggttttaaccccggggtttttaccggggggggaaaccccgggggtttaacccgtaaacgggttaccgggttaacggggtaaacgttaaccggttaaaaaccccggaaaacccgggtttaaccgggtttcgggttaacccgggtccccggttttaaaggaccccccgtaaacccgtttaacggttttcccgtttacccggttttaccctttaacccgttaaaccccggtttttcccccgttaaccccccgg

SEQ ID NO: 3898 - DNA, 889 bp, Homo sapiens
  misc_feature: GYAE6OF01BX2LT.39.31.C09.1.454.CMB.1.raw
  modified_base (119)..(119): a, c, t, g, unknown or other
  misc_feature (119)..(119): n is a, c, g, or t
  modified_base (137)..(137): a, c, t, g, unknown or other
  misc_feature (137)..(137): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcnccgtacgggacatcggtnatcgaccctagtcctaccgagtaccctcccgtgggcttgttcgtctcggtcgggcgaggtacgggtaccactataccaacgtcggacctaacggtaccacggaccgtaagtacggttttacgtttaaaccaacggtaacggtaaccaaaacgtaaagttaacgttaactttaccgttcgtacgttacggaaccagactaaacggaaaccgaggaccgactccttacgttaggtcacttactaagtttcgacggactacgtaccggaccggcggttcccggtccacggtactactcggacggcggtacgacggttccggtagtacgaacggtactaagtttacctccgtaacctccgtaaccacctaggtaccaacggtcgtacgtcccgtcggacggtaccggtacgtaaacggtaacggttacggtaacgggttacggttaacggtttaaccgtttttaacccggttaagtttcggttaacggttacgtaacgttaaacggtttaagtttaacgttaaccggtttaccgtttaacccgttaacgggtttaacccgggttttaaccccggggtttaagggggtaaccccggggttaaaccgaaccgggttacggtaacgggggtaaactaaacccgggtaaaccgtaaaaccgggtttacggtacgggttaccggtaaccgttaccgtaacccgtttacgtaccgtttaccgttaaaccgttttcccttaacccgttcccgttaacccccgg

SEQ ID NO: 3899 - DNA, 778 bp, Homo sapiens
  misc_feature: GYAE6OF01BZ27G.39.31.C09.1.454.CMB.1.raw
  modified_base (130)..(130): a, c, t, g, unknown or other
  misc_feature (130)..(130): n is a, c, g, or t
  modified_base (136)..(136): a, c, t, g, unknown or other
  misc_feature (136)..(136): n is a, c, g, or t
  modified_base (332)..(332): a, c, t, g, unknown or other
  misc_feature (332)..(332): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtgccgtacggganatcgtnatcgacccagtctccagacctcccgtgctgtcgtctcgtgggcgaggacggccacactacaactcgcaagtccagccagtagttcgtttaacacgtacggtaccaaactaaagtaagtaactttacgtccgtacgttcgaaccacggacaaaccggaaaccgtacggaacacgcccgttaaccgttaaagggttcnccttaccgtaaacgtttttccgacggggacctacggttacccggtaacccccggggtccgggttaacccgggggttccccgtacgaacccgtcggtttaccaacggggtccccggtaggaaccgggtccggggtttcacgggaacgtaacgtggttaactttacccgtaaccgtcctaacccgaccacgttacgaccggtaccgtacgcccgtacggaccgaacggtcgtaacggaagttacgttcggtacgtaacgtttacgtttaacgtttaacgtcgtcggagtaccgttaagttactttacgtaagttaccgttccgtaacgtttcgggttaccggtttacgggaccgggttacgaaggtcgtaaggacgtaactaaccggtaaacgttcgtagtcggactcgtacaccggttacttcgttacgttcctatcccgttacccg

SEQ ID NO: 3900 - DNA, 961 bp, Homo sapiens
  misc_feature: GYAE6OF01BG7Y1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctcgtggtcgccgtacggggacagtcggtgatcgacccagtcctccgacgtacctcccgtggcttgtcgtcctcggtcgggacggaggaccgggacccaccactacctaacgtcgaaccgtaacgtaccacgaccgtaaggttaacggtttacgttttaaccgaacgtaaccggtaaccaaaacgtaaacgttaaagtaacgtttaccttccggtacgttacggtaaccacggaacgaaacggaaccgacggacgaccgtaccgttaccttaacggttctaccgtacttacgtttacggtcggacctacgtacccggtacccgggtaccgggtcccgggtaccgtacggtaccgtacgttaccggacggtccggacgtacgggccggtaacgacggtaacgacgtacgtactttacccgacgtacctacctaacgtactacgaccgtacacccggtctaagggaccgtacgttacgggaacgtaacggtttcggtaacggttcccgggttaactttaacggttttaacgtacccggtagggttaaccctaaggttaacgtttaaaggtttttacccgtttaaaacgggtttaacccccggttccggtttaaccccggtttaacgtaaaccgggggtttttttaccccgggttaacccggggggaccccggttaaaacttccgggggtaaacggtaaacgggttaaccggttaaaaccggtaaaacccgggtttaaaacggcccgggttttaggggaaccccttaccccggggtaaactaaaccccgtacttttcccggtttaaggttaccccggtttaacccttccccgggttacccttttaccccccggg

SEQ ID NO: 3901 - DNA, 770 bp, Homo sapiens
  misc_feature: GYAE6OF01A386X.39.31.C09.1.454.CMB.1.raw
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
tcagtcgcactagtcacgaccggtgctcgatttagacgtctcatcaaggaaggaaggggcagcaagatggtgttgcagacccaggtcttcatttctctgttgctctgatctcgtggtcgccgtacgggacatcgtgatcgacccagtcctccgagacctccgtggctcgtgtctcggtgggacgaggacggcccacactcaagtcgacgtaccgtccacgaccaggttacgtttacgttaaccacgtacggtaaccctaaactaagttaaacggttaacttaccgttaccgtacgtttacggaacccgtagaccgtaaaccggaaaaccgacgggtaaccaccgttaccccttaggtagttccgtacttacttacgttacggcgtactaccgtacccggtcccgggtaccggtcccggtacgaccgtactcgtacggtaccgccgtcggacgggtcggtacgtacgacgtagtaccgttacctaccgtacctaccctacacgtacncggtacncgaccgacgtttttcgacgtacgacgtacgtagtaggttacgtacgtacgtttacgtttacgtacgttacgtacgtacgttacgttacgtttacgttagttacgttaccgttacggtacgttacgggttaccggttaccgggtaaccggtaacgtacggtacggtagtaacgtaccgtaacgtaccggtacgtacgtacggtcgtaccgtaccgtacgtaccgttacgttaccgttacctaccgtcccggttacccg

SEQ ID NO: 3902 - DNA, 588 bp, Homo sapiens
  misc_feature: GYAE6OF01EK3RH.39.31.C09.1.454.CMB.1.raw
  modified_base (401)..(401): a, c, t, g, unknown or other
  misc_feature (401)..(401): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctggggcgagagggccaccatcaactgcaagtccagccagagtgtttacacaggtccaaacaataagtaattacttcgcttggtaccagactagaaaaccaggacagcctacctaagttgctcatttacgtgggcagtcgtacccgggagtcccggggtccctgaccgattcagcggcaggcggtctgatacagtatttcactctcaccgatcagcacgctgcaggctagaanagtgtggtctaagtttatactgtgacgtcgtagttattagtagttaggtcctacgaagtacgttttacgggacccggggtaaccgaaggtacgagggtaacgtaagtaccgtaaaacggtaacgttaggttggacccgttggtacccgtaacgtacttacgttagttcctttccgtacgttaccccg

SEQ ID NO: 3903 - DNA, 835 bp, Homo sapiens
  misc_feature: GYAE6OF01D2U0D.39.31.C09.1.454.CMB.1.raw
tcagtcgcactagtcacgaccggtgctcgatttagacgtctcatcaaggaaggaaggggcagcaagatggtgttgcagacccaggtcttccatttctctgttgctctggactctctggtgcctacgggacatcgtgatacgaccagtcgtccgagactcccgtggctgtcgtctcgtgggcgaggaggcccaaccagtcaacgtcgacaaccgtccacggaccgagtacgttacgttttaacgacctacggttaaccaaacgaaactaaagtaacgttactttccggtaccttacggtaaccgacgaaccgaaacggaaaccgacggacctacgtaccttaaccgtaacgttaccgtaccttaacgtttacgtacgggacctaaccggttacccggtaacccgggtaccgggtacccgggttacccgtacggtaccgtacgttaccggacggacggtaccgtacgggtccggttacgacggtaacgtacggtaacgttacgttaccacgttaccgtaccctaaccgtactacgacgaccgacgtaccgtaggacgacggtacgtaagaacggtacggtacggtacgttaacgtttaacgtttaacgtttacggttacgtacgtacgtaagttaagtttaagttacgtacggtttaccgttaccgttaacggttacgggtttaaccgggtttaccgggggacccgggtaaaccgtaacgggtaccggtaaggtacggtaaaccgtaccgtaaacggtaacggtcggttacggacgttaccggacccttacgtaccgttaccgttacgttacccttacgttcccgtacccgtacccg

SEQ ID NO: 3904 - DNA, 768 bp, Homo sapiens
  misc_feature: GYAE6OF01AUXKQ.39.31.C09.1.454.CMB.1.raw
  modified_base (87)..(87): a, c, t, g, unknown or other
  misc_feature (87)..(87): n is a, c, g, or t
  modified_base (119)..(119): a, c, t, g, unknown or other
  misc_feature (119)..(119): n is a, c, g, or t
  modified_base (169)..(169): a, c, t, g, unknown or other
  misc_feature (169)..(169): n is a, c, g, or t
  modified_base (177)..(177): a, c, t, g, unknown or other
  misc_feature (177)..(177): n is a, c, g, or t
  modified_base (283)..(283): a, c, t, g, unknown or other
  misc_feature (283)..(283): n is a, c, g, or t
tcagtcgcactagtcacgaccggtgctcgatttagacgtctcatcaaggaaggaaggggcagcaagatggtgttgcagacccaggtnttcatttctctgttgctctggatctctggtcncctacgggacatcgtgatgacccagtctcagcctcctggctgtgtctcgngggcgagnggccaccatcaacctgctaacgtccacgcctaaggacgttcgtttacacgtacggtaccaaacgtaataagacttacttcgattacggccacgccaagtaaaccgngtaaccgactcccgtacttaagtcgtacctacgtaatttccgcgggaactacgtaccggttaccgggccggttacccggggtcccgacgaaccggtacttcgacggttaacgcccggaaggtccggggttacccgtaggtaaccgagtaacggtaccttttaccggtaaccgtacctttaaccggaccctaaaacccggttaccgacggtaaccgttacgtacccgtacggaccgtaacgggtaccttaagggtaacgtaacggttacgggtacgttaaacggtttacggtttaaccgtttacgtaacggttacgtacgtaaggtaccgttagttaaacggttacgttaccttacccgggttactaacggggtttacccgttacggggtacccgggtaaccggaacggtcgttaagggacctaaaggttacgaacggtacgtgtacggcttcggaccaccgtagtcgtatcttaccgcgttaccc

SEQ ID NO: 3905 - DNA, 755 bp, Homo sapiens
  misc_feature: GYAE6OF01A3WCM.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtcgccgtacgggacatcgtgatcgacccagtcctccagtacctcccgtggctgtgtctcgtgggcgagacggccaccatacaactcgaccaacgtccagccagtacgttgtttaacacacggtaccaaactaaagttaaacgtaactttacgttccgtacgttacggtaaccaagacgaacgaaaaccgaggaacaccgtccttacgtaagttcgccttactaactttaccgcggacctacttacccggtacccgggacggttccccggtcctacgtaccgtattaccgacggccggacgacgggtccggtacgtacggaacgtacgaagtttaccttaccgtacctccgtaccaacctacgtacgacgtaccgtcgtacccgtaggtacccgaacggttcctaaagggtaacgtcggttttacgggaccggttaacgttttaaccgtttacgttacgtcgttaacgacgttaacgtttaagttaattaacgttacggtaccgtttacctacgtaccggttttacgggttaccggggaacccgtaagacgtcggtaaggaaccttacgaaaccgtaacggtgtacgcggtacacctaccccgattcttacccgttgtttaccccttacgtccttacccg

SEQ ID NO: 3906 - DNA, 757 bp, Homo sapiens
  misc_feature: GYAE6OF01BKLBJ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctccctggctgtgtctcgtgggcgaggacgggaccacctatccaaacgtcgacctaacggtccacgacctaggtagtttcgttttaaccaacgtaacgggtaccaaaaccaaagttaaacgtaattttaccgttacgtacgttacggtaaccaggacaaacgaaaaccgtaggaaccacgtacccttaaccgttaagttcgtactacttaacgtttacgcgggtactacgtccggtacccggggtacgtacccggggtccctgaccgtattcgacggtcggacgacggtcggtctaggagtactagtactttaccgactcctacgacctatacgaacgccgagtcctgacgtacggtacgtacggaaagtcgtagggttacggttacgtttaagttttacctacgttagtccgtaaacgtccgttaagtttaattagttaaggtaccgtttacctaacgggtaccgtttaccggggtttacggggacccgggtaaccgtaacggtcggtaacggaacgtaccgtaaaaccgaaacgttacggttcggtacggtctaaccgactaaccgttcgttacttaccgttctaccctcgttcccccg

SEQ ID NO: 3907 - DNA, 762 bp, Homo sapiens
  misc_feature: GYAE6OF01A0OU9.39.31.C09.1.454.CMB.1.raw
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
  modified_base (315)..(315): a, c, t, g, unknown or other
  misc_feature (315)..(315): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtgccctacggggacatcgtgatcgacccagtctccagacctcccgtggctgtgtctcgtgggcgaggacgggcccaccatcaactgcaagtcccagccagtagttgtttacacacggtaccaaacaaataagtaattactcgtcttggtaccagacaacgaaaccngacactcctacctaagtcnctactactttacngtcgctacgtcccgtacccgggtacggtcccgggtccctagacccgtattcgacggccggcgacgggtccgggtatcggaagacgtaggtactttaccgacttacccgtacctaaccgtaatacccgtaacgaccctaacccgtgggaaccgtacggtaccgtaaggtaaacgtacgttacgggttacggtaacgtttaaacgttttagtttaaccttggtaccttaaggtaaccttaagtttaagttaattaacgggttcttacccgttaacggttaccggtttaaccggttttccggggtaacccggggtaacgtaaccgggtacggtaacggggtaacgtaaaccggttaaaccgaaaccggttaaccggttaggtacggtaccgttaccgtaccgtaaccctaacgtttccgtaaccgtttccttaccgttaccgttcccccg

SEQ ID NO: 3908 - DNA, 805 bp, Homo sapiens
  misc_feature: GYAE6OF01EHNVH.39.31.C09.1.454.CMB.1.raw
tcagtcgcactagtcacgaccggtgctcgatttagacgtctcatcaaggaaggaaggggcagcaagatggtgttgcagacccaggtcttcattttctctgttgctctggtatctcgtggtcgaccgtacgggtacactcgtagagtccgaccctagtcctaccagtcccgttcccgtgggtcttggtcgttccgttcgggtcgggacggacgggtacgggacccacctactaccgacgtcgacaaccgtccaggactaagttagtttacgttaaccgagtacgtaaccaaagtaacttaaagtaactttacgttcgtacggtttacgaaccgacgtaacaaacgaaaccgagaacgaccgttaccttacgtaacgttcgtcttacgtttcgttacgtcggacctacggttccgggtaaccgggttcccgggttacccggtccgtacgtaaccgtcgttaccggaacggtccgacgcggggtaccgtagttaggaacgtatacggttactacccgtccgtacctacgacctaactccgaggtctaccgtcggtcgacggtacgtacgtaacgtaagttggtacgttaggtacgtttacgtttaccgttagtacgtaacgtgtaacgtttagttaacgtacgtttacgaccttccgtaacggttcgggttaccgggttaccgggtaccgggacgtacgggaccgttaggtacgtaaaccgtaaaccgaacggtacggttaattaccggaacgtaacctacgtttacttacggttacttacctaacccggttccgtccgttaaccccg

SEQ ID NO: 3909 - DNA, 579 bp, Homo sapiens
  misc_feature: GYAE6OF01AT02I.39.31.C09.1.454.CMB.1.raw
  modified_base (310)..(310): a, c, t, g, unknown or other
  misc_feature (310)..(310): n is a, c, g, or t
  modified_base (384)..(384): a, c, t, g, unknown or other
  misc_feature (384)..(384): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctctaagttgctcattacgtggctagtccgtacccggnggtaccgggtccctagaccgattcgacgcggcaggtccggtctagagacagtatttcgactctacacactcgancacgcctgcaggtctagaagtagtggtggcttagtttactacgtagtcagtctaagttacttaagtagttacgtccttacgtaacggtttacggttttccggggaccggggtaaccgtagtccgtaggtacgtaactacggaaaacgtacgtggtcggtcctagaccacgtactctagttccttactcgttcccg

SEQ ID NO: 3910 - DNA, 903 bp, Homo sapiens
  misc_feature: GYAE6OF01CQ3J6.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctcgtggatcttctggtcgaccgtacgggacatcgtagatcgaccctagtcctccagacctccctggctgtgtactcgtgggacgaggaggcccaacctactacaactgacaacgtccacgtccgtaaggttactttacgtaaccaaccggtaaccgtaaacctaaaataaaacgttaactttaaaccgtttaccggttcgttaccggttaacgtaaccgaccgtaaacggaaaaccgaaccggtaaccgaacgttaccccgttaaccgtttaaccgttaggtcctacgttacgtttaaccgttacgggtaccgtaaccttcccggtaacccggggtaacccgggtaccccggggttccccggttaacccgacggtacccttacgtccggaccggtccggacgggaccgggttcgtaccgtaaacgagaccgttagtttccctaaccttcccacgtaaccctacgacacggcccgtacaccgtcgacgtacggacgtaacggtaacgaggttacggtaggtaccgttaaacggttttactttaaccgagtttaacccggtacgaaccgggtttattaaaggtttacgttaagggttccgttaaaccgtttacggtacccggtttaaccgggttaccgggtaaccgggggaaccctaaggtacggtaaccggttaacgtaaacggtaacccgtaaccggttaaaccggttccgggttaggtccgtaaacccggtcccgtaaaacgttcccctttaacggtttccctttccgtttacccgtacggttttcccccctaacccgg

SEQ ID NO: 3911 - DNA, 648 bp, Homo sapiens
  misc_feature: GYAE6OF01A9HS0.39.31.C09.1.454.CMB.1.raw
  modified_base (461)..(461): a, c, t, g, unknown or other
  misc_feature (461)..(461): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatcgacccagtctccagactccctggctgtgtctcgtgggcgagacggcccaccatcaactgacaagtccagccagtagttcgtttacactacggtaccaaacaaataacgtaactttacttccgtcgttacggtaaccaggtacaacgaaaccgaggacacgtacctacttaagtcgtactactacttacgtggacctacgtaccggtaccgggacggttcccgggtaccctacggaccgtacttccgacggtcggacgacggtcggtcgtagacacgacgttactttccgactctacacctatacgacgtcgactcgtacgacgnggctaaggatgtaggcgtacttagttactagtcgtcgtacgcttaagttacgttaagttacgtactaccgtagtacggttacggttacgggaccggtactacggacgtaggactaccggacgtaaaccgtcgtggacgtacacgtaaccacggttacctacgtttaccgtactcgtaccgttacccg

SEQ ID NO: 3912 - DNA, 761 bp, Homo sapiens
  misc_feature: GYAE6OF01ADWLZ.39.31.C09.1.454.CMB.1.raw
  modified_base (370)..(370): a, c, t, g, unknown or other
  misc_feature (370)..(370): n is a, c, g, or t
  modified_base (487)..(487): a, c, t, g, unknown or other
  misc_feature (487)..(487): n is a, c, g, or t
tcagtcgcactagtcacgaccggtgctcgatttagacgtctcatcaaggaaggaaggggcagcaagatggtgttgcagacccaggtcttcatttctctgttgctcgtggatctctggtgccgtacggggacactcggtgatacgacccgagtctaccagacctcccgtggcgtgtgtccgtcgtcggggacgacggacggccaaccatacaacgtgacaacgtaccacgaccaagtagtttacgttttaacgaaccggacggtaaccaaaacgtaaagttaaacgtaacgtttaaccgttcgttacgttacggtaccgaacggacaaacgtaaaccgaaggtaacaccgtccgttaacgtaaggttaccnctacgttacttacggtacggacttaccgtaccggtacccgggtacggttcccggtacctcgaccgtactacgacgtcggacgtacgtcggtactgacacgaatcttacgacttaccncgtaacgacacgtacgacctacgccgacgacgtacggtcaaggacgtaggtcggtaagtaccgtttattaccgtttagtaggtccaaaggttacgtaacgtttaatacccgtaagtcgtacgtacgttaaagttcccgtaacgggggtacgtaaccggtaatacccgggtaagtacccgaaactaacgttaaaccgggcttaccggttgcccttaacgggtacccaccgttactttacggttaagtccctttaaaccgtccgtttaaccccggg

SEQ ID NO: 3913 - DNA, 950 bp, Homo sapiens
  misc_feature: GYAE6OF01EA3A2.39.31.C09.1.454.CMB.1.raw
  modified_base (662)..(662): a, c, t, g, unknown or other
  misc_feature (662)..(662): n is a, c, g, or t
tcagtcgcactagtcacgaccggtgctcgatttagacgtctcatcaaggaaggaaggggcagcaagatggtgttgcagacccaggtcttctatttctctgttgctcgtgatctcgtggtcgccgtacgggacacgttcggtcgaagtccgtaacccgtacgttccttaccgacgtacccgttcccgttggtcgttcggttggttccgttcgggtacggggaccgggacggaccgggaccctacctaacttaccgaacgtacggaccgtaaccgtacccgaggaccgttaaggttaacgtttacggtttttaaccaacggttaacggttaacccaaaaagttaaacgtaaaacggttaacttttaaccgtttaccggttaccggtttaaccggaaccaaccggaacgaaaaccgggaaaaccgtaaccggaaccgtacgttacccttaacggtttaccggttacgtaccttactttaacgtttacggtaccggtaccgttaccggttacccgggtacccggggtaccggggttaccccggttacccgtacgtaaccgttacgttacggaccggtacgaccgggtacggttcggtaccgtaaggtaacgtaaacggacgtttaacttccgttaccttaccgaccgactaccgacggtacgtacncggtcgtacggacgttaggtacgtaacggtaattcgggtgtacgtttaccgttttaagttttaccgttacgtggttaaaccgtagttaacgttaaaggttttaaccggtttaagttacccgggtttaccgtttaccgttacggtacggtttaaccgggtttacggggacccgggtaacgacggttcggacgtaacgttaacgaaacggttaccgtagggttaccgtggtaacccgttgaaacccgttcgttacttcggtttaaccgtccttttccgaaccgtttcccg

SEQ ID NO: 3914 - DNA, 634 bp, Homo sapiens
  misc_feature: GYAE6OF01A4QMO.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagtagttgttttacacgacggtaccaaacaaataagaatttacttcgtcgtttggtaaccagcaagaaaccgaggacacgtcctacctaagttcgcctactatttacgtgggacacgtacccgtacccggggtacggttcccgggggtcccctacggacccgtattcgacggtaccgggacgtacgggtcgggtactggagacagtactttcaccgtctaccaccatcagcagcctagcgtacggactagaagtgttggtgacttaagtttactacgtgtacagctaagttattagtagtactacgtctaggttcgtttacgggaccgggtacacggtcgtaggaacgtataaccggtaaagtcgttaggtacgggtctacgggaccttacgaacttccgttacttcccgttgtcccttacccccg

SEQ ID NO: 3915 - DNA, 643 bp, Homo sapiens
  misc_feature: GYAE6OF01BUVM1.39.31.C09.1.454.CMB.1.raw
  modified_base (508)..(508): a, c, t, g, unknown or other
  misc_feature (508)..(508): n is a, c, g, or t
  modified_base (519)..(519): a, c, t, g, unknown or other
  misc_feature (519)..(519): n is a, c, g, or t
  modified_base (613)..(613): a, c, t, g, unknown or other
  misc_feature (613)..(613): n is a, c, g, or t
  modified_base (621)..(621): a, c, t, g, unknown or other
  misc_feature (621)..(621): n is a, c, g, or t
  modified_base (634)..(634): a, c, t, g, unknown or other
  misc_feature (634)..(634): n is a, c, g, or t
tcagtcgcactagtcacgaccggtgctcgatttagacgtctcatcaaggaaggaaggggcagcaagatggtgttgcagacccaggtcttcatttctctgttgctctggactcctctggtgcctacggggacatcgtgatcgacccagtcctccgacgactccctggctgtgtctcgtgggcgaggacggccaccagtacaactcgacacggtccagccagtacgttcgtttacacgtacggtccaaacaataacgtaacttacttcgcttcggtacacgacaagaaccagacacgtcctactagtcgctactattcgtcggctacgtccgtacccgggtacggttccgggtcctacggaccgtcgtcgtaggcgtacgacggtcggggtactacggacgacgtagtacgttttaccaccgttcctaccaccgtacgtccgacggacctacggtcccgttgaccgtaacgggtctaaggtaaacgtgtaggtcgtaacgtttacgtttnttacgtcgtanggtctaagttagttagtactaccgttactcgtacgttcgggtttaccggaccgggtacacggtgtaccggagttccaacgaacgtcgtggccgntcgctacnttcgtcgtctacnccgttcccg

SEQ ID NO: 3916 - DNA, 769 bp, Homo sapiens
  misc_feature: GYAE6OF01APJRI.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtcctccagactccctggctgtgtctcgtgggcgaggacggccaccactcaactgacaacgtccagccagtacgttgtttacacgacggtaccaaacaactaagtaactttaccgttcgtacgtttacggaacccgagtaccgaaacgaaaacccgaggaaccgaccgtcccttacccgtaaaggtttcgaccttacgtacgtttaccggtgggacctacgtaccggtacccgggtacggtacccgggggtccctacggacccgtacgttccgacggtcggaaccgagggtccgggtacgttacggaacgacccgtaagttactttaccgaccgttaccctaccaacccgtacgttaccggacgacccgtaacgtccccgttagaccggtaaaggccgtttaaggaacgtaacgttcgggtaccgtagttaagtttaccttagtcgtaccgagttaaccgtaagtttataacggttacgttaccggttacgttaccgtaacggtttccgggtttaccggggccggtaacgtacggtcgtaggactaacgaccgttaaacgcggttaggaccgtccgttacgaacgttccgtaagttccccttaggtactacccgttcttaccccg

SEQ ID NO: 3917 - DNA, 693 bp, Homo sapiens
  misc_feature: GYAE6OF01EXEBG.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctctgggcgaggagggccaccatcaactggacaacgtccagccagtagttgtttacactaggtaccaaacaataagtaatttacttcgcgttacggtaccagacaacgaaacccgaggtaacacgtcctaccgttaagttcgactactaacttttacgcggggtctacgttccggtacccggggtacggttcccgggggtccctaggacccgtagttcaggtccgggacgtacggccgggtacgtaggacgacgtaaggtcttttacgaccttcctaccaaccgaattccgaagccacgtccgtagacgtaggaccgtaagacgtacgttgggtacgtaccgttttaaggtttacttaccggttagtaccgtaggtacgtaaggtttaacttagtaagttaccgtcgtacgtcggttaacggtttcggggaccggggtaccaagtcggtaggtacgactaccgtaaaacgcgtggtacggtcgtctacgtaacctggttaccttaggttccttacgcttccccg

SEQ ID NO: 3918 - DNA, 731 bp, Homo sapiens
  misc_feature: GYAE6OF01BKAIF.39.31.C09.1.454.CMB.1.raw
  modified_base (185)..(185): a, c, t, g, unknown or other
  misc_feature (185)..(185): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (404)..(404): a, c, t, g, unknown or other
  misc_feature (404)..(404): n is a, c, g, or t
tcagtcgcactagtcacgaccggtgctcgatttagacgtctcatcaaggaaggaaggggcagcaagatggtgttgcagacccaggtcttcatttctctgttgctctggattctcgtggtcgccgtacggggacatcgtgatcgacccagttcctaccacgtacctcccgtggctgtcgtttttcncgtgggcgaggacggacccactatacaacgtgactaagtaccgacgcgtaaggttacgtttacgtttaccgacgtacggtaacaaacgtaaagttaaagttaacttacgttcgtacgttacggtaaccaaggaccgaaacgaccgagacgacgtaccttacgttaggtcncgtacttagttcggngtacctcgttaccggaccggtcggtccggtaccncgaccgtactcgaggtcgacgacgtcggatgaacgagtacgtactttccgactccaccgtactagtacgtacgaccgtcgttaccggcgtacgtacggtacgttaagtaacctcggttacggttgttaaccttagggttttactacgtagtaccgtataacgttagttacgttacgacgtttacaaccggtagttacgttaccggttaacgggacccgtaagtccgtaaggtgtaacgtaaccgtaacgtaaccggtgttcggcccgttagcccgttaccgtacgttaccggttcttaacggttccctaaccggttccttaccccgg

SEQ ID NO: 3919 - DNA, 805 bp, Homo sapiens
  misc_feature: GYAE6OF01ESM8Q.39.31.C09.1.454.CMB.1.raw
  modified_base (645)..(645): a, c, t, g, unknown or other
  misc_feature (645)..(645): n is a, c, g, or t
  modified_base (653)..(653): a, c, t, g, unknown or other
  misc_feature (653)..(653): n is a, c, g, or t
  modified_base (671)..(671): a, c, t, g, unknown or other
  misc_feature (671)..(671): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacagtcgtgatcgacccagtcctaccagacctcccgtggctgtcgtctcgtggcgagacggccaccactcaactgaccaacgtccacgccgagtacgttacgttttaacacgtacgtaaccaaactaaagtaacgtaactttacgttccgtacgtttacggtaaccacgtaccgaacgtaaaaccgacggtaaccaccgtacccgttaaccgttaacgtttaccgtaccttaaccgtttaacgttttaaccggtacggggtacccttaacccggttaccccggggttaaaccccggggggtacccgggttttacccccgggggtaccccgtacgggtaacccgttacgttaccggaccgggtccggaccggtacgggtccggttacgtacggaacggtaaccgttaagttaccgtttacctaccgttacctaccgtaaacccgtacgtacgaaccgccgtaacggtccgtagaccggtgacgtagaacgtggtcgtacggtacttattacgtacgngtacgtanagttaatacgttagtacncttagacgttaggttaccggttaccgggacgactacgtcggtagtaacgtactaaccggtaagttacggtggacccgttcgaacgttaccgacccttaggtttccctaacggttcccttgtccccgttaacccg

SEQ ID NO: 3920 - DNA, 844 bp, Homo sapiens
  misc_feature: GYAE6OF01CRP3P.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgaccctagtctaccgacgtacctcccgtggcctgtgtctacgtgggcgagaggccacgatcaactgcgagtccagcagtagttcgtttacacgagtaccaaacgaataagtacttacgtcgtagttacggtaccacgacaaacggaaacccgaggtaacgtacgtacccttacgtaacgttccggtacctacttaacgttttaacggcggactacgttacccggtaccccggggtacggttcccccggggttacctacgggtaaccccgtcgttacgaaccgggccgggttaccgaacggggtttcccgggtacggttacggaaacgggtaacccgtacgtttaaacgttttccaaaccgttccttaaacccgaccttaaccgtcgtaacgaccgaccggtccgtacgaccgtacggtacgtaaggtaacggtacgttcggtacggttaacgtttacgttttaacgttaacgttacgttaccgaacgttacgttaagggttttaataaaggtttacgttaccgtttaccgttaacgtacgggtttaccgggttttaccggggaaccggggtaaccgttaacgggtaccggttacggtaaacgtaccgtaaccggtaaaccgttacgggttaccgggttaaccggtcgtaccggtaccgtaaccgttcgttacgtttacccgtacttcgttaacccgtttccccgg

SEQ ID NO: 3921 - DNA, 799 bp, Homo sapiens
  misc_feature: GYAE6OF01CY28S.39.31.C09.1.454.CMB.1.raw
  modified_base (424)..(424): a, c, t, g, unknown or other
  misc_feature (424)..(424): n is a, c, g, or t
tcagtcgcactagtcacgaccggtgctcgatttagacgtctcatcaaggaaggaaggggcagcaagatggtgttgcagacccaggtcttcatttctctgttgctctgatctcgtggtgccgtacgggactatcgtgacgtcgacccgtatccggggggtccagtcctcccgtgctgtgtcgtcgtcgggagaggacggaccaccgactaccgaacgtcgacgtaacgtccgacgaccaggttacgttactttaacgaccgtacggtaaccaaacgtaaataaacgttacgttaccgtccgtacgttacgtaccgacgacgaaaacgaaacccgagaacgtaacgtcctacgttaacgtcgccttaacgtacgtttacggacggtctaacgtaccccgggtaccggaccggttcccgggtacccncggtaaccgtacttaccggaccggtccggacgacgggttccgtacgtacggaacgttaccgtaacgtttctaccgtacttaccctaccgaacctagttaaccgacgacgtaccgtcccgtaaggacccggttagaacgtaacgtaggtaacgttcggttaagggtttacccgtttaattccgtaacgtcgaaccgttgtaaacgttttctaccgttacttaccgtactacggttacggtttaccggtcggaaaccgttcggaacctcggttacgacggtacctaacggccgtccgtaaaagggtccggtcgttaaacgccgtaacctacccgttaacggtaccctttacgtcgttaaacccgttaccgttacccg

SEQ ID NO: 3922 - DNA, 986 bp, Homo sapiens
  misc_feature: GYAE6OF01DQ0YY.39.31.C09.1.454.CMB.1.raw
  modified_base (955)..(955): a, c, t, g, unknown or other
  misc_feature (955)..(955): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggactatcgtgatcgacccagtctaccagacctcccgtggctgtcgtctcgtgggcgagacgggaccaccagtaccaacgtcgacgtaaccgtccgacgccgtaaggtagtttacgttttaaccaccgtaacggttaaccaaaacgtaaactaaagttaaactttaccgttacgtacgttacggtaaccgaagaccgaaacggaaaaccgacggaacctaccgtacccttaacgttaacgttcgtaccttacgttaccgtttacggtacggtacctaaccgttacccgggttaaccccgggggtaccgggttacccccgggggttaccccgttaccgggtaaacccggttacgttaaccggaccggtcccgggtacggtaaccggggttcccggggttcggtaacggtaaccgtaacgttaaccggtttaccgttttacccctaaacccgttcccgtaacccctaaccgtaccgtaaccgtaacccgtaccgaacccgttcccgggtaacggtaaccggtaccgggttaaacctaggggtaaaactttccggttaggggtaaaccggtttccgtttttaaaacggttttactaacccgggtttcgggaaacccgtacggtttacgttaaacggtttttaacgtttaacgtttaccgggtaaaccccgtttcggtaaccgtttaaccggggggttttaccgggttaaccccgggggaacccgggtaacgttaacgttccggggtaaacggtaacttaaccggtaaaccggtaaacgttcggttaccgggacgtacccggtaccctaaccgtaaacgttcctttaaccgnggtttttaacccctcgttaaccccgttcccg

SEQ ID NO: 3923 - DNA, 727 bp, Homo sapiens
  misc_feature: GYAE6OF01AGN8L.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacagtcgtgatcgaccctagtcctccagacctcccgtggtctgtgtctcgtgggcgagaggccacatcaactgcaacgtccagccagtagttgttttacacgacgtaccaacaaataagtaattaccttcgcgttcggaccagacaacgaaccgaggacacgcctaccgtaagttcgcttctatttcgcggtactacgtacccgtacccggggtaccggttcccggggtaccctacggtacccgtagttacgacggccggacgagggtccggtacgtacggaacgacgtaggttaactttcccgtaaccgttcctaacccacccgtaataccgtaccgaccggtaccgtacccgtcgaccggtacggtacgtaacggaacgtaggttacggtacggtaccgttttaagtttacttacgtcgtacgtagtacgtaatttattacgttaagtaccgttactacgtacgggttacggtttacggggacccggtaaccgagtacggtagtacgtaacgtaaaccggtaaacgttccggtaggtcggtaccgtacgtacctaccgttacgttccgtagttaccctttcgtcccgttacccccgg

SEQ ID NO: 3924 - DNA, 821 bp, Homo sapiens
  misc_feature: GYAE6OF01B2GEW.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtcgccgtacggggacagtcgtgatcgacccagtcctaccacgtaccctcccgtggcttgtgtcctcgtgggacggagacgggcccaccatacaactgaccgaacgtccacgaccgagtagttacgtttaaccacgtaacgtaccaaacaagtaaacttaactttactccggtcttacggtaccagacaaacgaaaccgaggaccacgtacctaccgttaagttcgtacttctactttacgtcgggactacgtacccggtacccggggtaccgggttcccggtcccgtacggacccgttacgtcggacggtccggacgtacgggtaccgggtacgtaggaaccgtaacgttacgttacctttacccgtacccttaccgtacccaaccctaccgtaccgaaccgaccgacgtcccggtagaccgggaggtaccgaggtagttaggttcgggtagttaaccgtttaagttttactaacggttactaacggacttaacggttaagtttaactttcggtaaccgtttaccgttaacccgtacggttaaccgggttttaccggggttacccggggaacgggtaccggtaaccgtagggtaacgtaaccggtaccgtaacccggtaaaacggttccggtcgggttacctccggtccgaacccgtacccgttactttccgttaccgtttccgttccttaccccgttacccccg

SEQ ID NO: 3925 - DNA, 767 bp, Homo sapiens
  misc_feature: GYAE6OF01AF0D2.39.31.C09.1.454.CMB.1.raw
  modified_base (363)..(363): a, c, t, g, unknown or other
  misc_feature (363)..(363): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
tcagtcgcactagtcacgaccggtgctcgatttagacgtctcatcaaggaaggaaggggcagcaagatggtgttgcagacccaggtcttcatttctctgttcgcttctggtactctctggtcgccgtacgggactatcgtgatcgaccctagtccgtccagtcctcccgtggctgtgtcgtgtcggcgaggcggtcccaactacgtctaacgtgaccgaacgtccacgccgtaggtacgtttcgtttaacacgtacgtaaccaaacgtaaagtaagttactttaccgttacgtcgttacgtaccgacgtaacaaacgaaccgtaggacctaccgccttacttaagtcctgtacttagttcggngtccaacgttcccggccgggtacgttcccgggacctacgaccgngttcccgngcgggtaactcggtcggttcgagaggaaccgtattcgtttacccacgttccaacgtaccttaggaccgcgtccgtacggtcgtcccgacgggttacacgttaggtaaccggtagttcggtacttaccgtttaacgttacgttcgcgttaacgtaggagtttaaccgtgtttaaccgtacttccggtaacttaccggtacgtttaacccgggacgggttaacccggtacgtaacggttcccggttaaagacgttaaaccggaaccgttaacgggtttcggaacccgttagggtcctaccgtaaccgtcggtttacgtacgttcccgttccgttaacccgtcccccgttaaacg

SEQ ID NO: 3926 - DNA, 726 bp, Homo sapiens
  misc_feature: GYAE6OF01BOXOM.39.31.C09.1.454.CMB.1.raw
  modified_base (366)..(366): a, c, t, g, unknown or other
  misc_feature (366)..(366): n is a, c, g, or t
  modified_base (661)..(661): a, c, t, g, unknown or other
  misc_feature (661)..(661): n is a, c, g, or t
  modified_base (677)..(677): a, c, t, g, unknown or other
  misc_feature (677)..(677): n is a, c, g, or t
tcagtcgcactagtcacgaccggtgctcgatttagacgtctcatcaaggaaggaagggcagcaagatggtgttgcagacccaggtcttcatttctctgttgctctggatctcgtggtcgccgtacgggacatcgtgatcgaccctagtcctccaacgtcctccgtggcttgtgttcgtcgtgggcgaggcggtccaaccgactacactgacgacgtccgacgcgtaaggtcgtttcgtttaacgacgaacggtacctaaacgtaaacgttaaacgtaactttacgttcgtccgttacgtaccgaacgacgtaaacgaaaccgtagaccaccgtacctacgttaagttcgctacttacgttcgacgntacccgtccggtaccgggtaccggtcccggtccgtacgtacgtacgttacggcgtcggtacgtcggtacggtacgaggtacgacgttacgtaccttcgtaacctccacctaaccgtacgtaccgcggtaccacgtccgtgaaccgtacggtacgttaacggaccgttaggtcgttacggttaactttaacggtttacgtacgtcgtaacgtaagtaccgttattaacgttaccgtaacgttccgtaacgttacggtacgttacgggtaaccggacgtacgtacgtagccggtaanagtaccggaactcggngtacggtctaaccgcgttactacgttctcgtttactcccgtccgtcccg

SEQ ID NO: 3927 - DNA, 803 bp, Homo sapiens
  misc_feature: GYAE6OF01AWOA5.39.31.C09.1.454.CMB.1.raw
  modified_base (149)..(149): a, c, t, g, unknown or other
  misc_feature (149)..(149): n is a, c, g, or t
  modified_base (485)..(485): a, c, t, g, unknown or other
  misc_feature (485)..(485): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtcgaccgtacgggacatcggtgactcgacccngtcctccgactcctcccgtggctggtcgtcgtgtcgggacgaggaccggcctaaccacttaccgaacgtcgacgtaacgtcccgacgtacgaggtacgttttacgtttaacacgtaacggacctaactaaatacgtaaactttcgtacgtcgttacgaaccgagaccgtaaacgaaccggacgtacgtaaccgtcccttacggttatccgcttagttaccgttaggtccggactaccgttacccggggtacccgggttacggttccccggtacccgtagaaccgttcgtaaccggcggacgtacgggtcggtaacggttcgaacggataaccggtnttaccgtttaccaactcccgtaccgtaacgtcctaccgagacccgtacgtcgatccggagggtacacgggtattccggtagggttacgtaacgttttaacgtaccgtttaggtcccggttaaaggaccttaacggttagtttacgttagttaacccgggttcctaccggtacgttacccggggtttacgggaccggggtaacccctaggtaagtcccgggtaatccggtaaacgtactaaacccgggtacgtgggttacctaccgtacgtacccgagttaccgttgttaccccgttacgacccgttttcgtacccccg

SEQ ID NO: 3928 - DNA, 875 bp, Homo sapiens
  misc_feature: GYAE6OF01ER98M.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctaccagacctccctggctgtgtctcgtgggcgaggacggccaccatcgaactgacaacgtccagaccagtagttacgtttaacacgtacgtaccaaaacaaataaagtaactttacttcgtacgttacggtaaccagaccaaacggtaaaaccgacggaaccacgacccttacgttaagttcgactacgttactttacggcggactacgttaccggtacccggggtaccggtcccgggtcctacgaccgtacgttcgacggcggtacgacgggtccggttacgtaggtaaacgaccgtaaacgttacgttttaacccgaacctttaccctaaccgtaacccgtaaaccgttaccgtaaaccggaacccgtaaccgggttccccgtaacgggtaacgtaacccgggttaacgtaaagggtaaacgttacgggtttaacgggttacgggtaaaccttttaaaggtttttaaacgttaccgttacggtaacgtaacggttaccgtaaaggtttttaacttaaacgggttaaccggttacgtttaaccccgttacgggttaaaccgggtttttaccggggtttacccgggggaaccccggggtaaactaacgggttacggttaacggaaacgttaaccgtaaaacgggtaaaccgttaaggcgggttacgaccgtaccgaaccctacgttacctttcgtttagtaacccctttcgaacccgtttacccccg

SEQ ID NO: 3929 - DNA, 827 bp, Homo sapiens
  misc_feature: GYAE6OF01A7F11.39.31.C09.1.454.CMB.1.raw
tcagtcgcactagtcacgaccggtgctcgatttagacgtctcatcaaggaaggaaggggtcagcgaagagtggtgttgcagacccaggtcttcatttctctgttgctctggatctctggtcgccgtacgggacatcgtgatcgacccagtctccagacctcccgtggctgtgtctcgtgggcgaggacggccaccatacaactgacaagtccacgccagtagttcgtttacacgacggtaccaacaataagtaacttacgttcgcgttacgaccagacaacgaaaccgaggacacgtcctactaagtcgactactacgtttacgcggactacgtaccggtacccggggtacggttccccgggtcccgtacggtaacccgtacttaccgacggtaccggacgacgggtaccgggtaccgtacggaacgtacgtaacgttacgtttacccgtaacctccgtacccaaccgtacaccgtaacgtaccgtaccggtccctacggtacgaccgggtaataacgggtaacgttacgggttccggtaacgggtacgtttaacgttttaaccgttcgttaccggtacgtacgtaacgtaacgtttaagtttaactacggtttacgtacccgttaaccgtaacgggtttaacccgggtttacccggggaacccggggttaaccgtaacgggtccggtacgggtaaagtaaccccgttaaaaccggtaaacggttaccggtaagggttcccggaccgttaacccggtaacccgtacccgtttaacccgttccggttaacccgttttccccgttaaccgttacccccgtttaccccgg

SEQ ID NO: 3930 - DNA, 771 bp, Homo sapiens
  misc_feature: GYAE6OF01E3Y8N.39.31.C09.1.454.CMB.1.raw
  modified_base (710)..(710): a, c, t, g, unknown or other
  misc_feature (710)..(710): n is a, c, g, or t
  modified_base (742)..(742): a, c, t, g, unknown or other
  misc_feature (742)..(742): n is a, c, g, or t
tcagtcgcactagtcacgaccggtgctcgatttagacgtctcatcaaggaaggaaggggcagcaagatggtgttgcagacccaggtcttcatttctctgttgtctcgtggactctcgtggtcgccgtacgggacagtcgtgactcgacccgtacgtcctaccgacgtacccgtcccgtcggtcttggttcgtccgttccgggtaggggacggaacgggaccggaccctaccacgttaccaacgtcggaaccgtaaccgtccctacgaccgtaaggttacgtttaccgtttaaccgaacgtaaccggtaaccaaacgtaaaagttaaattaacgtttaccgttcgtacgttaacgtacgaacgaaccgaaccgaaaaccgaggaccgacgtccgtaaccgttaagttccgtcttacgttacgttaccggcggtacgtaccgtacccgggtcccgggtccgggtacccggtccgtacgtccgtactcggacggcggacggcggcggtactagacgtagtacgttcttctacctccaacgtacactcggacgtaccgcgtacggtcgccgtaggacgtaacgagtgtacggtgtaactttcgttacttcggatagacggttagttaactttagtacgtcgtaccttcggttacggttacggttaccgggttccgggaacgtaacggtccgtaagtacgtaacgtaacggtaanaaccggtgtcggacgttcaccgttagtacctnttacctacgttccttaacgtccctaccgg

SEQ ID NO: 3931 - DNA, 751 bp, Homo sapiens
  misc_feature: GYAE6OF01CRCG7.39.31.C09.1.454.CMB.1.raw
  modified_base (501)..(501): a, c, t, g, unknown or other
  misc_feature (501)..(501): n is a, c, g, or t
  modified_base (562)..(562): a, c, t, g, unknown or other
  misc_feature (562)..(562): n is a, c, g, or t
  modified_base (698)..(698): a, c, t, g, unknown or other
  misc_feature (698)..(698): n is a, c, g, or t
tcagtcgcactagtcacgaccggtgctcgatttagacgtctcatcaaggaaggaaggggcagcaagatggtgttgcagacccaggtcttcatttctctggttgctctggatctcgtggtcgccgtacggggatatcgtgatcgaccctagtcctccacgtacctcccgtggacttgtgtcgtcggtgggacgacggacggcccaccacgtaccaacgtcgacgaaccgtccgacgaccgaagttacggtttactttaaccgacgtacggtaaccaaaacgtaagttaaacgtaacgtttacgttcgtaccgttacggtaaccagaacgaaacggaaacgaacggacctaccgtaccttacgttaacgttccgtactaccgtttagttccggtcggacttaccgtacccggtacccgggtacggtcccggtactcgaacgtcgtacgcggcggaccgtggtccgtacgagacgtacgttacgtactttccgactacctaccnctatccgacgtagccgtcgtggacgagtgtacgaagttcgtaggacgttagttccgtttanccgtaagtcgtacgttaactagtttactaacggtgtttacccttacggtacgtttacccgggttaccgggttcgggaacccgtaagttacgggtcgtaaggtaacctaggtaaaccgaacggttcgtgggtaaccncggtacttacccgagttttccttacggtaactttcctaccgttccgtacccgg

SEQ ID NO: 3932 - DNA, 658 bp, Homo sapiens
  misc_feature: GYAE6OF01ALXO4.39.31.C09.1.454.CMB.1.raw
  modified_base (304)..(304): a, c, t, g, unknown or other
  misc_feature (304)..(304): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacacggtccaacaataagtaattacttcgcgttggtaccagcaagaacccaggacacgcctaccgttaagtcgctactatttacgnggactactccgtacccgggagttcccggggtcctacggaccgattcgacgcggcgaggtcggtctagacgtacgaagtctttaccaccgttctaccacctacgtacacggtacacggtcccgttcgacgtacggtccgtagaaacgtactgggtacgtacgtttaaaggttttcgtaacgtcgtaccgtagtactaagtttattaagtaacgttcgtaaccttacgtaggttaccggttttacggggaccgggtaacctaacggcgttacgggaataccgtaactaacggtaaccgttggtacggtccgtacgccctactacgttcctacgttccttaccgtccgtttaccccg

SEQ ID NO: 3933 - DNA, 763 bp, Homo sapiens
  misc_feature: GYAE6OF01E4OS0.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccgtggctgtgtctcgtgggcgaggaggccaccatcaactgcaagtccagccagagttgttttacactaggtacccaaactaaataaagtaactttacgttccgtacgtttacggtacccaaggaccaacggaaaacccaaggaaccacgccctaccgttaagttcgtcctacttaagttttaccgtcggggtaccacgttaccggtaccccgggggtacgggttccccggggtccccgtacggtacccggtactaccggtaggccgggccacgggtccggggttacgtaggaacgacgtaagttaaccgttttccacctccgtacaaccctagtacgacgtcgacgtccccgttgaccgtacggtccgtaaggtaagtaacggtttcggtacggttacgtttaacgtttttaacgtcgttcgtaccgagtaaccgttagtttaactgttaacggttaccttccgtaacggtaccgtttacgggttttccgggggacccggtaacgtagccggtttaggaactaacgaaccggtaaaaccgtcgggttagtcgggtccacggtacctacccggttattcggtttacttacttcccgaaccttttcccg

SEQ ID NO: 3934 - DNA, 820 bp, Homo sapiens
  misc_feature: GYAE6OF01COW12.39.31.C09.1.454.CMB.1.raw
tcagtcgcactagtcacgaccggtgctcgatttagacgtctcatcaaggaaggaagggggcagcaagatggtgttgcagacccaggtcttcatttctctgttgctctggatctctggtgccgtacggggacatcgtgatcgacccagtctccagacctccctggctgtgtctcgtgggcgaggacgggacctaccataccaaacgtgacgaacgtacccacggacctaaggtaggtttacgttttaaccaacgtacggtaacccaaaacgtaaaagttaaataaacgtttacttcggtaccgttacggtaaccaagacgaaacgaaaaccgaaggaacaccgtaccttaccgttaaaggtctaccgttactaagtttaccggtaggacctacgtaacccggtacccggggtaccggttcccggggtcccgtacggtaacccgtacgtacgacggccggtacgacgggtcggtccgtaaggaactacgtagttactttccgaaccttaccgtaacccgtaacctacgtaaccgaaccgaccgtaccggtaccgtacggacgtaggaaccgtaaggaacgtaggtcgtacggtactttaacgtttaacttagtacggtacgtagtagtaaagtttagttaaacgtttacggttaacctacccggttaagttaccgggttttacgggttaccgggaacccgggggtaactacgggtaacggtacgggaaacgtaaaccgaaaccggtaaaccgtgtacggtccggtccgttacgaccgtaactaccgtttaccgtgtttaccctacgtaccccgttacccccg

SEQ ID NO: 3935 - DNA, 810 bp, Homo sapiens
  misc_feature: GYAE6OF01BPCER.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctcccgtggctgtgtctcgtgggcgaggacgggcccaccataccaactgacgaacgtcccgagaccgtaggtagtttacgtttaaccacgtaacggtaccaaaactaaataaagtaactttaccgttacgtaccgtttacggaacccaggaccgaaaacgaaaacccgagggtaacccaacggtcccttaacccgttaaggtttccggaccttaacttaacggttttacgcggggtactaccggttacccggtaacccgggggtacggttccccggggtacctacggtacccgtacgttcggacggccggacggtcgggcggtacgtaggaacgtactacgttactttcccgacttaccacctaaccctactaccacgtccgtaaccgtccgtacggacgtacggtccggtaaggtaacggtaggtcggttagggttaacctttaggttttaacttacggttcgtaacgtacgtacgtttaattacgtttacgtaacggttaccgttccgtaacggttacggtttacgggtttaccggggaccgggtacggtagtacggtaggtaacgtacgtaaaaccgtaacggtggttacgggacgtccgtcggaacctacgttcctttacggtacctttcgttaccgtcccgttcccccg

SEQ ID NO: 3936 - DNA, 833 bp, Homo sapiens
  misc_feature: GYAE6OF01CMQCR.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtctccacgacctcctggctgtcgtctcgtgggacgaggacggccaaccatacaactcgacacgtaccacgtccgaagtagttcgtttaacaccgtacggtaacccaaataaacttaaagtaactttccgttccgtacgttacggtaaccaacgtacgaaaccgaaaccgacgacgaccgtcccttacgttaaggttcacgttacttaagtttaccggtcggtactacgttacccggtaacccggggttaccggttcccgggggtaccccttaggtaaccccgtacgttaccggacggtccggaccgtcggggtccggttaacgacggtaacgacgttaaccgttacgtttacctacctactacccgacctactacgaacctccgactcccggtagccgtaacggtctaacgggtaacttcggttacgggttaccgttaacgttttaaccgttttagttaccgtagggttaccaagttaacctttaaggtttaactttaaacggttacgtttaacccgttacgttaccgttaaccggggttttacgggttacccggggaaacccggttaaagacggtcggttaacgtaaaggtaaccctaaacgggtaaacgtacgggtttcgtaaccggtcctaaccgacccttaactaccgttgtttaccccggttacctacgttcccgttaccccg

SEQ ID NO: 3937 - DNA, 897 bp, Homo sapiens
  misc_feature: GYAE6OF01A22T8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctcccgtggctgtgtctcgtgggcgagacgggccaccagtcaactggacaacgtcccagccgaagtagttcgttttaacacgtacggtaaccaaacgaaattaaacgtaaactttaccgttaccgtacgtttacgggtaaacccaacgcgtaaaaccggaaaaaccccgtaagggaaaccctaccggtacccccttaaacggtttacgtaccttaccgttaactttaaccggttcggggtaaccgtacctacccggtaaccccggggtaacccgggttcccggggtaccccgtaccggtaccggtaactttaccggaccggtccgggtaccggaacggtccgggtaccgtaacggtacggaaacgtacggtttaaccgtttacctacccgttaacctcccaaaccgtacccgtactacggacccgtacgtccgttaaccggccggtaacggacgttaacgggtaacggacggtttacggtaccggtaagtttaaccggtttttaacgttaacgtttcgttaccgtaaggttaccgttacgtttaaacgttagtttaaccgggttaacgttaacccgttacgttaaccgggtttacgtttacccggggtaccggggttaaccctagggtaccggtacgggtaacgtaaccggtaaaccgtaaaccggtaacgttcgggaggttcccgtacgtaccgtaacctacgttacgttccgttacgtacccttcgttaccccgttacccg

SEQ ID NO: 3938 - DNA, 742 bp, Homo sapiens
  misc_feature: GYAE6OF01B2DZL.39.31.C09.1.454.CMB.1.raw
  modified_base (364)..(364): a, c, t, g, unknown or other
  misc_feature (364)..(364): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatcgacccagtcctccagacctcccgtggctgtcgtctcgtgggcgacggagggcccactatacaacctggacaacgtccacgcccgtagtacgttgtttaaccacgaacggttacccaaataataaacgtaactttaaccttcggtccgttacggtacccaaggtaccaaacggaaaacccaggtaccacggtaccctacgtaagttcgaccttactaacttttaccgnggtacctacggtccgtaacccggggcgttacccggggtacctgaaccgtatccgacgtcggccgaggtccggtacaggaacgacgttaagccttttaccgaccttaccgactaacccgataccgtaacgaccacgcccgttagaccgtaggctacgaacgtcgtaggtacgtagtacgtttaacgcgttacggactagaacgttaagtattaacgtaggttacgtaccgttacgtacggttacggtttacgggaacccggggtaacctacggggtaccgtacggttacggtaaaccgtaaccggttaaacggtccgtaggccgggttaccacggtaccctacgtacttcggtaacttccgttaaccgtcccttacccg

SEQ ID NO: 3939 - DNA, 776 bp, Homo sapiens
  misc_feature: GYAE6OF01A6XBQ.39.31.C09.1.454.CMB.1.raw
  modified_base (308)..(308): a, c, t, g, unknown or other
  misc_feature (308)..(308): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtgatgacccagtctccagacctccctggctgtgtctcgtgggcgagaggccaccatcaactgcaagtccagccagtagttgtttaacacaggtaccaaacaataagaatttacttcgcttacggtacagacaagaaaccaggacacgcctactaagttcgctactatttacgnggctacgtccgtacccggggcggttcccgggtccctaggacccgtattacgaggaccggcgacggcggggtactacggaacgtacctaaggtactttaccgacttacccgtacctaccgaacgttaccaaacggccgtaacgtcccgttacggaccggtaagggaccgttaaggaaaggtacgttacgggtaggttaccgtttaagttttaacgtttacgttacggtacgtaacgtacgttaacggtttaactttacgtttaacgttaccgtttaaccgttaccggttaacgggttttaaccgggttttaccggggggaaccccgggggttaaccgtacggtaccggttaaggggaacgtaaaccgtaaaccggtaaaaccggttaacggttaggttccgggtacttaccgaccgtaaccttaccggtttacgttaccggttacctttaccgtacccgttttaccccg

SEQ ID NO: 3940 - DNA, 863 bp, Homo sapiens
  misc_feature: GYAE6OF01CZKS7.39.31.C09.1.454.CMB.1.raw
  modified_base (622)..(622): a, c, t, g, unknown or other
  misc_feature (622)..(622): n is a, c, g, or t
tcagtcgcactagtcacgaccggtgctcgatttagacgtctcatcaaggaaggaaggggcagcaagatggtgttgcagacccaggtcttcatttctctgttgctcgtggatctcgtggtcgccgtacgggacagtcgtagagtcgaccagtcctccgagtacctccgtggctgtgtcgtcgtggcgaggacggacccactatcaaccgtgacgtaacgccacgaccgtagttacgtttacgtttaaccaacgtacggtaacccaaagtaaaagttaacggttaactttaccgttacgtaccggttaacggtaacccgaaggaaccgtaaacggaaaccgaacggaacctaccggtcccttaacggttagttaccgcttaacgtttacgttacggcggacttaccggtacccggtaacccggggtccggtttacccggttaccacggtaaccgtcgttacggcggaccgggtcgtaacgggtcccggtagtaacgtaaccgtacgtaacgtttaccgttaccaccttacccgtaccgtaactacggtacggaccgaccgtacggtccgacggaccgtaggaacctagtacggtacgtcgttagttaacgttacttaccgttanacggttacgaagtagtttaagtttaacgtacggttaacgtaccggttacgtacggtttaaccgggttccgggttaacggggaaccgtaaaccgtggggtaaaccggttacgtaaaccggtaaacgttaaaacccggaaacgggtttaccgtaacgggttacccgtacgttaaaccggaccgtttaaccgttaaccggttaccctttaaccgttacgttaacccctcccggtttaaccccgg

SEQ ID NO: 3941 - DNA, 841 bp, Homo sapiens
  misc_feature: GYAE6OF01AL0PX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggacggccaaccatacaacgtgacaacgtccacgccagtacgttcgttttaacacgtacggtacccaaactaaataaacgtaatttaccttcgtcgtttacggtaaccagaccaaacggaaaacccgaggaaccacgtacccttaccgttaacggttcgtcccttacttaacgttttaacggcggggtacctaacgtaccccgggttaaccccggggtcgggtttccccggggttccccgttacggaacccgttcgttaccggacggtccggaccggtacgggtccggggtactacggtaacgaactacggttactttaccgtccgtaccttaccgaactacgtacgaccgcgtaccgtccgtacggaccgtagtacgtaaggtacgtagttggttaccggtaagttttaccgtttacgttaacgttcggtacgaacgttaacgttaagttttaacgttaagggttaacccgttagttaccccggtaagtttaaccggggttttacccgggttaacccgggggacccggtaactaccggggtgtaacggtaaccgtaacgtaaaacccggtaacgttaccgggttggtaacccggtattaccccgaccttaaacccgttctttaccggtccgttttaccttaccccttacgggttacccccg

SEQ ID NO: 3942 - DNA, 814 bp, Homo sapiens
  misc_feature: GYAE6OF01A1IDU.39.31.C09.1.454.CMB.1.raw
  modified_base (667)..(667): a, c, t, g, unknown or other
  misc_feature (667)..(667): n is a, c, g, or t
  modified_base (786)..(786): a, c, t, g, unknown or other
  misc_feature (786)..(786): n is a, c, g, or t
  modified_base (800)..(800): a, c, t, g, unknown or other
  misc_feature (800)..(800): n is a, c, g, or t
tcagtcgcactagtcacgaccggtgctcgatttagacgtctcatcaaggaaggaaggggcagcaagatggtgttgcagacccaggtcttcatttctctgttgctctggattctcgtggtgccgtacgggacatcgtgactcgaccagtcctccagcctccgtggctgtcgtctcgtcgggcgaggacggccacactcaaccgtgacaacggtccacgaccaaggtagtttcgtttaacacgtaacggtaccaaaacaaattaagtaacttacgtcgtacgttacggtaaccagaccgaaaacgtaaaccgacggaaccgtccgtacccgttaaccgtaagttccggaccttacgttacgttttacggaccggtaccgttaaccggttaccccgggttaaccccggggtaaccgggggtttcccccggggttacccgttaaccggaacccggtttacgttaccggaaccggtccggggtaccgttaccgggccgggtttaacgtacgggtaacgaacgggtaaccgtttaccgttacccgtaacccttcccgtaaccctaacgacgttaacccggcgttaccggtaccggaccgttacggacccggtaggtacgtaacgggtaagtcgtacggttaaccgacgttttaacgttcgttaaccgttacgngtaaccgttaactataacgtttggtacgtccgttacgtacggttaacggttcgggtacgggtaacccgacgtaggtacgaggtaactaccgaacggtacgtacgtcgtaggtcgtaccncgtactcttacgtntacgtctacccgtc

SEQ ID NO: 3943 - DNA, 811 bp, Homo sapiens
  misc_feature: GYAE6OF01DASHQ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctgatctctggtgccgtacgggacatcgtgatcgacccagtctccagtacctccctggctgtcgtctcgtgggcgagacggccaccgatcaactgacaagtccagccagtacgttagtttacacgtacggtaccaaactaataagtaactttacgttccgtacttacggtaaccagaccgaaacgaaacgacggaccacggtccttaccgttaaggttcgtaccttacgttactttacggtggacctacgttacccggttacccggggtaacggttccccgggttaccttaccggaacccgtttacgtacccgcggtaccgggacgacgggtccgggtcgtcggaacgaacgtacgtttacttctaaccgttccgtaactacccgtagttaccgaagtcccggaacgtccgtacggtaccggtacggtacgtaacgtaacggttacgttagggttaacggtacgtttaagttttaaccgttaccgtttacggaaccgtaggtaaccgttaagtttaacttacggtttaagtacccgtaccgtttcgtaaccgggtttacggtttacccggggacgggttaaccgtacggtcggttaacgaacgtaccgtaaaccgtaaccggtttagtacgggttaccgtccgtaaccgtacccgttaacgtacgtttacccgtagggtttaccctaccttcccggtttacccccgg

SEQ ID NO: 3944 - DNA, 768 bp, Homo sapiens
  misc_feature: GYAE6OF01BY4XN.39.31.C09.1.454.CMB.1.raw
  modified_base (337)..(337): a, c, t, g, unknown or other
  misc_feature (337)..(337): n is a, c, g, or t
  modified_base (552)..(552): a, c, t, g, unknown or other
  misc_feature (552)..(552): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacgggacatcgtgatcgacccagtcctaccagcctccgtggctgtgtctcgagggcgagcggccactatacaactgacaagccagccgtagtaggtttctttaaccacgtacggtaccaaataaagtaacgtaatttcgttcgtaccttacggtaccagacgaaacgaaaccgaggactacgacctaccttaaggttcaccttatactttacgnggtactacgtaccgaccgggtcgtccgggtcctaggcctagtcgacggcgtccgagggtccgggttacagggaactacaacggtttctttccgactttaccaaccaacgttcggtacaaacgcgtaccggccctggccgaaaccggttcgtaaacggaaggtcgttacggggtacgttacttttaagttttaaccgggttcctaggttaacccgngttaaacgggtttaatttaacgtttaaaggtaccggtttcgttaaaccccgtgggtttaaccgggttttaacggggtttaacccggggcccgggggaaacctttaagggtcccggttaaggaaacgttacccggtaaaacggttaaacgcccggttttggggaactccgggttaccacccgtaacttcttcgggtattccctagtcccttaccccg

SEQ ID NO: 3945 - DNA, 881 bp, Homo sapiens
  misc_feature: GYAE6OF01DNENP.39.31.C09.1.454.CMB.1.raw
  modified_base (118)..(118): a, c, t, g, unknown or other
  misc_feature (118)..(118): n is a, c, g, or t
  modified_base (129)..(129): a, c, t, g, unknown or other
  misc_feature (129)..(129): n is a, c, g, or t
tcagtcgcactagtcacgaccggtgctcgatttagacgtctcatcaaggaaggaaggggcagcaagatggtgttgcagacccaggtcttcatttctctgttgctctggatctctggtnccgtacggganatcgtgatcgacccagtctccagacctccgtggctgtgtctcgtgggcgaggacgggccaccactcaaactgacgaacgtccacgaccgaggtacgtttcggtttttaaccaaccgtacggttaaccccaaaacgtaaaacgttaaaaggttaaactttaaccgtttcgtaccgtttaacggttaaaccgacgaacgaacgaaaaacccgaaggaacccgaaccgtcccttacccgtaaaggtttcgtaccgttaccttaacgttttaacccggttacggggtaccgtaaccggttaaccccgggttaaaccccccggggggtaacccggggtttcccccgggggggtttaccccgttaccgggtaaccccggtaacgttttacccggaaccgggtcccgggtaccgaacggggtccggggtaccgttaaggaacggtaaaccgtaaggtaacgttttacctaccgttacctacccaaacctacttaccgaacgccgaaccggtacccgtacggacgtaacgggtacctaacggtaaagggtacgttgggtacggttaaccgtttagtttttaacgtttacgtaaccgttacgtaacgtaacgttaacgtttaattaacgttagttaacgttcccgtacgttaacggttacgttacgggggtacccggaacgtacgtacgtaaggacgtaactacgaaacgtaccgtggtacgtcgtacgccaacgtcgtactcgttactcgtcgtaccccg

SEQ ID NO: 3946 - DNA, 750 bp, Homo sapiens
  misc_feature: GYAE6OF01DZF84.39.31.C09.1.454.CMB.1.raw
  modified_base (149)..(149): a, c, t, g, unknown or other
  misc_feature (149)..(149): n is a, c, g, or t
  modified_base (327)..(327): a, c, t, g, unknown or other
  misc_feature (327)..(327): n is a, c, g, or t
  modified_base (666)..(666): a, c, t, g, unknown or other
  misc_feature (666)..(666): n is a, c, g, or t
  modified_base (695)..(695): a, c, t, g, unknown or other
  misc_feature (695)..(695): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacgggacatcgtgatcgacccagtcnccacgactccgtggctgtgtctcgtggcgagacggccacgataccaactgacaacgtccagaccgaggtacgttagtttaccgacgaacgtaccaaacgtaaataaacgtattaccgttcgtcgtacggtaccagaccaaacgaaaccacggaaccacgtaccttaaccgttaggttntaccgtacctttaacgtttaccggtggtactacgtcccggttaacccggggtaccgggtcccgggtaccgtcggtaacgtatacccggtaggccggacgagggttccggtacgtacggaacgtaaccgtagttacctttacctaaccttcgtaaccaaccgtttaacgacgtaaccggacgtaccgtcggttaccgacggacgggtactacgggtaaatacggttggtaacggttagttaacggtttacgtacttacggaactcggtaattaacgttagttaccaggtttaacctcgttaaggtaaccggttcgggttacccgggacggtaatacggtntaacgggaataaccaacggtaaacgtcgnggttaccgtgaccgtctaaacccgtgttaccgttcctaacttccgacccgtcccg

SEQ ID NO: 3947 - DNA, 725 bp, Homo sapiens
  misc_feature: GYAE6OF01CT02T.39.31.C09.1.454.CMB.1.raw
  modified_base (359)..(359): a, c, t, g, unknown or other
  misc_feature (359)..(359): n is a, c, g, or t
  modified_base (430)..(430): a, c, t, g, unknown or other
  misc_feature (430)..(430): n is a, c, g, or t
  modified_base (470)..(470): a, c, t, g, unknown or other
  misc_feature (470)..(470): n is a, c, g, or t
  modified_base (663)..(663): a, c, t, g, unknown or other
  misc_feature (663)..(663): n is a, c, g, or t
tcagtcgcactagtcacgaccggtgctcgatttagacgtctcatcaaggaaggaaggggcagcaagatggtgttgcagacccaggtcttcatttctctgttcgctcgtggatctcgtggtcgaccggtacgggacagtcgtgagtacgacccagtcctaccgacgtaccctcccgtggtcgtgtcgtccgttcggcgggacgacgggacggacccaaccatacaacgtgacacgcacgctaaggtagttacgttacacgtacgtaaccaaataaataacgtacttacgtcgtacgttacgaccgaagacgaaacggaacgaggacaccgtcctacgttagtcacgttactagttacggngtacgtaccgtaccggtaccgggtccggtcccggtacacgtacgtctacggcgacgtcgacggtccggtanagaacgtacagttactaccgactaccactaaactagaccncgtactccgagacgtacggtacgaaggtagtagtaggttacgttaactttaaggtttaacgtacctagtaacgaagtacgttaaagtttaccgttagtacccggttactacgttaacggttacggtttacccgggacgggaaccgacgacggtagaacggtaacgaacgtaacccgaaggtacgtcgggtacnccgtaacgacctaacggttcgtctttaccgtaaccgttcctttaaacccgcccgttaacccg

SEQ ID NO: 3948 - DNA, 706 bp, Homo sapiens
  misc_feature: GYAE6OF01AGOEZ.39.31.C09.1.454.CMB.1.raw
  modified_base (183)..(183): a, c, t, g, unknown or other
  misc_feature (183)..(183): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (418)..(418): a, c, t, g, unknown or other
  misc_feature (418)..(418): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctcccgtggctgtgtctcgtggcgagngggcccaccatcaacgtgacaacgtccacgccagtagttcgtttaaccgacgacggtaccaaaactaaattaaacgtaactttacttcgtaccgtttacggaacctaggacaaacgaaaccgacggacacggtccctacgtaagttcgacctntaacgtttacgngggtaccacgtcccggaccggggtacggtcccgggtcctcgacctcgtcgacggcgacgacggtccggtnacggaagtacgacgttacttccgactctaccgactatacgacgtacgacgtccgtcgacgtaggtacgtacgaaaggtcgtaggtacggtagtttaacgtttactcgtaaggaccgagtaccgttaagttacttaacgttcgttaaccgttcttaaccggtacggtttaaccgggttcgggggaaccccgtaactagggtcgtaagggactaacggtaacccgaaaggtcgtagggttccgcgttacacccgtaacgttcgtaccgtgttaccctacgtccttccccg

SEQ ID NO: 3949 - DNA, 930 bp, Homo sapiens
  misc_feature: GYAE6OF01ACMD6.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtagatcgacccagtcctaccgacgacctcccgtggctgtgtctcggtcgggacggaggacgggcctaccactaccaacgtgaccgtaacgacccgacggacctaagggtacggttttacgttttaaccgaaccgaccggggtaacccaaaacctaaaagttaaacgtaactttaaccgttccggtacgtttacggaaccacgacgaaaccgtaaacccgacggaaccgtacgcccttaaccgttagtctacgtactacgtttacgcggtctaccgtccggtaacccggggtaccgggttcccgggtacccgtaccggaccgtacgtaccgcgggtccgtcggacgggtcggtcaacgggacgtacgtacgttacttacctaccctaccgttacaccgtacttcccggacgaccgtaacccgtccgtccggacgtaccgggttaaccgtaaggtaaccggttagggttcgtaccgggttaacgttttaacggttttacgtttaacccgttacgggtacttaagggttaaccggtttaaccgttttaagttttaaacccgtttaacgggttccgtttacccgtttaaggttacccccggggttttacgggggtttacccggggaaccccgggttaaaccggtaggaacccggttaagggggtaacctaaaccgtaaaccccgggtaaacgttccggggttaacccgggttacggtaccgtaaacccgggaaccctttaaccgtcccgttttaacggtttccccttaaccggttttcccgttaaccccttttccccgggg

SEQ ID NO: 3950 - DNA, 621 bp, Homo sapiens
  misc_feature: GYAE6OF01BD32X.39.31.C09.1.454.CMB.1.raw
  modified_base (308)..(308): a, c, t, g, unknown or other
  misc_feature (308)..(308): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgacaacgtccagccagagttgttttacacacggtaccaaacaaataagaattacttcgcttacggtaccagcaagaaaccaggacacgcctacctaagttcgctacatttacgnggctagtccgtacccgggacggtcccgggtccctagaccgtattcgacgcggcgaggccggtctgacgactacgtactttccacttctaccaccatacgacgccacggtccgtacgcgtacgcgtacgtaagagttcggtaggtacgttaagtttacttacgtgtacagtactagttaacttagtacgtacgtacctacggtaacgttacgtttacgggaccgggtaacaaggtcgtaggaacgtacgtaaccggaaacgtacgttggtacggtcgtcgtaccaaccgtatcgtagttcctcgttacctcccg

SEQ ID NO: 3951 - DNA, 675 bp, Homo sapiens
  misc_feature: GYAE6OF01AR4MD.39.31.C09.1.454.CMB.1.raw
  modified_base (144)..(144): a, c, t, g, unknown or other
  misc_feature (144)..(144): n is a, c, g, or t
  modified_base (199)..(199): a, c, t, g, unknown or other
  misc_feature (199)..(199): n is a, c, g, or t
  modified_base (456)..(456): a, c, t, g, unknown or other
  misc_feature (456)..(456): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (591)..(591): a, c, t, g, unknown or other
  misc_feature (591)..(591): n is a, c, g, or t
  modified_base (618)..(618): a, c, t, g, unknown or other
  misc_feature (618)..(618): n is a, c, g, or t
  modified_base (657)..(657): a, c, t, g, unknown or other
  misc_feature (657)..(657): n is a, c, g, or t
tcagtcgcactagtcacgaccggtgctcgatttagacgtctcatcaaggaaggaaggggcagcaagatggtgttgcagacccaggtcttcatttctctgttgctctgatctctgtgcctacgggacatcgtgatcgaccagtcncagtactcccgtggctgtcgtcgtcgtgggcgaggacggccaacactacactcgntaacgccacgcagtagttacgtttacacgacgtaccaaactaaattaagtaacttaccgttcgtcgttacgtacccagacgaaaccgtaaaccgacggaaccaccggtaccctttaccgtaagttcgtaccttacgttaacgtttacggtacggcctaaccgttaccggtacccgggggtaccggttccccgggtcctacggtacgtacgttcgacggcgaccgtagggccgtagagtacgatacgttctcgtaacncgtcacgtacgngacncaccgtcgacgtcgtcgagtagacgtgtacggacgttacttaaggttcctgtcgactgtaagttattaactggttaactcggtactacgttacggttccggttacgggaccgagtacgnggtacgtaatacgaccgtaagtaccgnggtacggcttcgtaaccctcgtaaccttcttaccgtttntaccgttccgttaccccg

SEQ ID NO: 3952 - DNA, 872 bp, Homo sapiens
  misc_feature: GYAE6OF01CE3AM.39.31.C09.1.454.CMB.1.raw
  modified_base (128)..(128): a, c, t, g, unknown or other
  misc_feature (128)..(128): n is a, c, g, or t
  modified_base (299)..(299): a, c, t, g, unknown or other
  misc_feature (299)..(299): n is a, c, g, or t
  modified_base (532)..(532): a, c, t, g, unknown or other
  misc_feature (532)..(532): n is a, c, g, or t
  modified_base (547)..(547): a, c, t, g, unknown or other
  misc_feature (547)..(547): n is a, c, g, or t
  modified_base (555)..(555): a, c, t, g, unknown or other
  misc_feature (555)..(555): n is a, c, g, or t
  modified_base (574)..(574): a, c, t, g, unknown or other
  misc_feature (574)..(574): n is a, c, g, or t
tcagtcgcactagtcacgaccggtgctcgatttagacgtctcatcaaggaaggaaggggcagcaagatggtgttgcagaccaggtcttcatttctctgtgctctggatctcgtggtgccgtacggganactgtagatcgaccctagtctcagtcctccgtggtctgtgtctggtgggcgaggacggtaccactactacaacgtcacgtaacgtccacgcctaagtacgttacgtttaccgaacgtaccggtaccaaagtaagttaaacgtacttacgttcgtaccgttacggtaacccngtaacgaaaccggtaaaccgtagggaccctacggtaccctttaaccggttaaggttcctaccgtttacggttaaccgtttacggtccggtaacctaccggttaaccggggtaccccggggtcgggttaaccccggtcccgtaacgtaccggttaacgtccgggacggtcggtaccggtacggttccggggtactacggataacgtcgttaacttcccgaactcgacctaactntaacgccgcgtaccncggtacgngtacgtagtactaacggtnaccggttcggttacgttacgttaacctggtttaaccagttacgtaacgtttaacggttacgttaaacgttcgggttacccttaccggtaacggttacccgggtttaaccgggtacccggggtaaccggtaacggttcccggttaagggttaacccgggtaaaccgtaaaggttaaaccccgggttacggtacccgggttaacccgggttcggtaacccggttacctaaacccgggttccctttagggtttaccctaacccgggtttacccttttcccggaacccttttaccccccggg

SEQ ID NO: 3953 - DNA, 850 bp, Homo sapiens
  misc_feature: GYAE6OF01BKI6D.39.31.C09.1.454.CMB.1.raw
  modified_base (162)..(162): a, c, t, g, unknown or other
  misc_feature (162)..(162): n is a, c, g, or t
tcagtcgcactagtcacgaccggtgctcgatttagacgtctcatcaaggaaggaaggggcagcaagatggtgttgcaggacccaggtcgttcatttctctgttgctctggatctctggtgccgtacggggacatcgtgatcgaccagtctccagacctcccnggctgtgtctcgtgggcgaggacgggaccaccatcaactgacaacgtccagtccagtgttagtttacacgtacgtaccgaaactaataagtaacttaccgttcgacgttacgggtaccaagtaccgaacggaaaaccgacgggaccaacggtcccttaccgttaaggttcgaccttacgttaacgttttaacgcggggtacctacgttacccgggtaaccccggggttaccgggttccccggggttaccctcggtaaccgtacgtttaccgacgggccggacgtacgggtccgggtactaggtaaccgacgtacgtaactttccgaaccgtcctacccgaaacgttcctaaccgacgtaacggtcgtacccggtcggtacggacgtacgtaaggacgtacggttacgggactaaccgtttagtttacgttacgtacggtaacgtaccgaacgtttaagttaaccgtttggtaaaccgttacggttcccggtttaaggtaaccggggttttccggggttaaacccgggggccccgggtaaacccgtttagggaccggtttaaggaacccgttttaacgaaacccggttaaacggaaccgtttggggtacccgttaccggttaacgaacccccgtaacgttaccgttaacccgggtttccttacccttaacggttccccttaacccccgg

SEQ ID NO: 3954 - DNA, 784 bp, Homo sapiens
  misc_feature: GYAE6OF01EQQIH.39.31.C09.1.454.CMB.1.raw
  modified_base (426)..(426): a, c, t, g, unknown or other
  misc_feature (426)..(426): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctcccgtggctgtgtctcgtgggcgaggagggcccaccatccaactgacaagtccagccaagagttgttttaaccacgtacggtaccaaacaaataaagtaactttaccttcgtcgttacggtacccaggaccaacgaaaacccaggaacacgtccttaccgttaagttcgaccttatacgtttacgtgggtcctacgttccggtaccccggggtaccggtccccggggttccctacggtacccgtattcgaggtccggacgaggtccgggtntaggagactagtactttccacctctacacctagtcagcgagtccgtgccgtaacggcgtacgtaaagggtacgtcgggtaggtaaccgtttaaggttttaactttaccggttagttccgaagtacgttaacgttttaaagttaaacgtttacgttaaccgtcccgttaggtaaccgggtttttaaccggggttttacccgggggaaccccgggggtaacctaacgggtcgtaacgggaacgtaaacgtaacccggttaaaaccggttacgtttacggggtaccggcgttacccggaacccttaacccttaacggtttcgttacgtttacccgtttaaccgttccctttaacccccggg

SEQ ID NO: 3955 - DNA, 998 bp, Homo sapiens
  misc_feature: GYAE6OF01B2FOL.39.31.C09.1.454.CMB.1.raw
  modified_base (375)..(375): a, c, t, g, unknown or other
  misc_feature (375)..(375): n is a, c, g, or t
tcagtcgcactagtcacgaccggtgctcgatttagacgtctcatcaaggaaggaaggggcagcaagatggtgttgcagacccaggtcttcatttctctgttgcttctggatctctggtcgaccgtacgggacagtcgtgacgtgacccagttcctaccacgtacccttcccgtggtccgttggttcgttccgttaccgtgggggacgacgggacgggcccaaccacttactaaacgttcgacctaaacggttcccgacgacccgaaggttacggtttacgttttaaccaacgtaacgggttaaaccaaaacgtaaacgtaaagtaacttttaaccgttcgtaccgttaggtaaccgagacctaaaacggaaacgngggaacctacggtaccttaccgttaagttctaccgttactagtttacgcgggtactacggtacccggttaccggggtacggtacccgggtaccctacgtaccggtacttacgggacgggtcccggtaggtaccggtaccggggtgtaacgggacgaacgttacgtttacccttttccgaacctttccccggtaactaaccccttagtaaccgggtaacctacccggtaaccgggtcccgtaccggtaaccggtaacgggttccgtaaagttaaacggggtaccgtttacggggttaaccggtttaacggttttttaagttttaacccttacgggtttaaccgtacggttaaacggtaccgtttaaagtttatttaaccggttaggttaccgtttaacctttaggggtaccggttttacccgggttaccgggggaaccccggggtaacgtaacgggttccggtaaacggtaacgggttaaacccgttaaaaccgggtaaaccgggtttaaacggggttccgggtaccgggttaaaccctaccgggggtttaaacccaaccggtttaccggtttaccgttaaacccggtttcccgtttttaccccgtacccgggtttaacccccg

SEQ ID NO: 3956 - DNA, 493 bp, Homo sapiens
  misc_feature: GYAE6OF02HQWNN.39.31.C09.1.454.CMB.1.raw
tcagtcgcactagtcacgaccggtgctcgatttagacgtctcatcaaggaaggaagggcagcaagatggtgttgcagacccagggtcttcatttcctctgttgctctggatctctggtggcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtgcagtttatactgtcagcagtattatagtagtctcagacttttggccggggtaccaagctggagatcaacgaactgtggctgcacatctgtcttcatcc

SEQ ID NO: 3957 - DNA, 497 bp, Homo sapiens
  misc_feature: GYAE6OF02IEUIG.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattacttgtcagcagtattatagtagtcctcagtacgttttggccggggaccaagctggagatcaaacgaactgtggctgcaccatctgtcttcatcc

SEQ ID NO: 3958 - DNA, 503 bp, Homo sapiens
  misc_feature: GYAE6OF02GYE7W.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtggctagttattactgtcagcagtattatagtagtcctctagtacgtttgggccggggtaccagcgtggagatacgaaacgtaactgtggctgcacatctgtcttcattcccg

SEQ ID NO: 3959 - DNA, 498 bp, Homo sapiens
  misc_feature: GYAE6OF02G42T7.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcagcgggtctgagacagatttcactctcaccatcagcagcctgcaggctgaagatgtgcagtttattactgtcagcagtattatagtagtcctcagtacttttggccggggaccaagcgtggagatacaaacgaactagtggctgcacatctgtcttcattccg

SEQ ID NO: 3960 - DNA, 495 bp, Homo sapiens
  misc_feature: GYAE6OF02HR05W.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtgctagtttattactgtcagcagtattatagtagtcctcagtacgtttggccggggtacaagcgtggagatacaaacgaactgtgctgcacatctgtcttcatcc

SEQ ID NO: 3961 - DNA, 490 bp, Homo sapiens
  misc_feature: GYAE6OF02J1JLJ.39.31.C09.1.454.CMB.1.raw
  modified_base (469)..(469): a, c, t, g, unknown or other
  misc_feature (469)..(469): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttatactgtcagcagtattatagtagtcctcagacttttggccggggacaagctagagatcaacgaactgngctgcacatctgtcttcatcc

SEQ ID NO: 3962 - DNA, 495 bp, Homo sapiens
  misc_feature: GYAE6OF02H7DBY.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggatccggggtccctgaccgattcagcggcagcgggtctgagacagatttcactctcaccatcagcagcctgcaggctgaagatgtggcagtttattactgtcagcagtattatagtagtcctcagtacgttttggccggggtaccaagctggagatacaacgactgtggctgcaccatctgtcttcatcc

SEQ ID NO: 3963 - DNA, 515 bp, Homo sapiens
  misc_feature: GYAE6OF02HRR4L.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcaggcggtctgagacagatttcactctcaccatcagcagcctgcaggctagaagtatgtggctagtttatactgtcagtcagtattatagtagtcctagtagtacgtttgggcccgggtaacaagcgtaggagtatacgaaacgactggtgactgaccactatcgtgtccttcattcccg

SEQ ID NO: 3964 - DNA, 506 bp, Homo sapiens
  misc_feature: GYAE6OF02JBFKE.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagttattactgtcagcagtattatagtagtcctcagtacgtttggccggggtaccaagcgtggagatacgaacgtaactagtggctgacaccatctgtcttcacttcccg

SEQ ID NO: 3965 - DNA, 497 bp, Homo sapiens
  misc_feature: GYAE6OF02HM9MA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagttattactgtcagcagtattatagtagtctcagtacgtttggccggggtaccagcgtggagagtacaacgaactgtaggctgcacatctgtcttcatcc

SEQ ID NO: 3966 - DNA, 493 bp, Homo sapiens
  misc_feature: GYAE6OF02GZAUO.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccgggtccctgaccgattcagcggcagcggtctgagacagatttcactctcaccatcagcagcctgcagctgaagatgtggcagttattactgtcagcagtatatagtagtacctcagtacgtttggccggggtaccagctggagagtacgaacgaactgtggctgcaccatctgtcttcatccg

SEQ ID NO: 3967 - DNA, 501 bp, Homo sapiens
  misc_feature: GYAE6OF02HOEZL.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctaccgggagtccggggtcctgaccgattcagcggcagcgggtctgagacagatttcactctcaccatcagcagcctgcaggctgaagatgtggctagtttattactgtcagcagtattatagtagtcctcagtacttttcggccggggaccaagcgtggagatacgaaacgaactgtggctgcaccatctgtcttcattccc

SEQ ID NO: 3968 - DNA, 495 bp, Homo sapiens
  misc_feature: GYAE6OF02FX2IL.39.31.C09.1.454.CMB.1.raw
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgatcgattcagcggcagcggtctgagacagatttcactctcaccatcagcagcctgcaggctgaagatgtgctagtttattactgtcagctagtattatagtagtcctacagtacgtttgggaccgggtacaagctaggagatacgaaacgatggtgctgcacatctntctntac

SEQ ID NO: 3969 - DNA, 503 bp, Homo sapiens
  misc_feature: GYAE6OF02IKKTE.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtggctagtttattactgtcagcagtattatagtagtcctcagtacgttttggccggggtaccaagcgtggagatacgaaacgaactagtggctgacaccatctgtcttcatcc

SEQ ID NO: 3970 - DNA, 491 bp, Homo sapiens
  misc_feature: GYAE6OF02GIDPH.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagttattactgtcagcagtattatagtagtcctcagacttttggccggggaccaagctgagatcaacgaactgtggctgcaccatctgtcttcatcc

SEQ ID NO: 3971 - DNA, 498 bp, Homo sapiens
  misc_feature: GYAE6OF02HSD7R.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtactttgggccggggaccgagcgtggagatacaaacgaactgtggctgcacatctgtcttcatcc

SEQ ID NO: 3972 - DNA, 497 bp, Homo sapiens
  misc_feature: GYAE6OF02GB59W.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagtgggtctgagacagatttcactctcaccatcagcagcctgcaggctgaagatgtggcagtttattactgtcagcagtattatagtagtcctcagtacttttggccggggtaccaaggctggagatcaacgaactgtggctgcaccatctgtcttcattc

SEQ ID NO: 3973 - DNA, 496 bp, Homo sapiens
  misc_feature: GYAE6OF02G1S2Z.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattactgtcagcagtattatagtagtcctcagtacttttggccggggtaccaaggctgagatcaacgaactgtggctgcaccatctgtcttcatcc

SEQ ID NO: 3974 - DNA, 507 bp, Homo sapiens
  misc_feature: GYAE6OF02I4CBK.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctccctaagttgctcatttactgggcatcctacccgggagtccggggtccctgaccgattcagcggcagcgggtctgagacagatttcactctcaccatcagcagcctgcaggctgaagatgtggctagtttattactgtcagcagtattatagtagtcctcagtacgttttgggccgggggtaccaagcgtggagatacaaacgaactagtggctgcaccatctgtcttcatccc

SEQ ID NO: 3975 - DNA, 585 bp, Homo sapiens
  misc_feature: GYAE6OF02I7GVJ.39.31.C09.1.454.CMB.1.raw
  modified_base (300)..(300): a, c, t, g, unknown or other
  misc_feature (300)..(300): n is a, c, g, or t
  modified_base (403)..(403): a, c, t, g, unknown or other
  misc_feature (403)..(403): n is a, c, g, or t
tcagtcgcactagtcacgaccggtgctcgatttagacgtctcatcaaggaaggaaggggcggagcaagactggtgttgcgagacccaggtctttcatttctctgttgctctggatctctggtgcctacggggacatcgtgatgacccagtctcctagactccctggtactgtgtctctgggcgagagggccaccatcaactgcaagtccagccaggacggtgttttacacaggtccaacaataagattactcgcttggtaccagcagaaaccaggacagcctctaagttgctcatttacncgggcagtcgtacccgggagtccggggtcctgaccgtattcagcggcaggcggtctgagacagatttcactctacgaccatcagcacgcctgcagctagaagntgtgctagtttatactgtacagcagtatagtagtacgtcctctacgttacgttttcgggaccggggtaaccgaacggtacgtagggtacgtacgtaacggaaacggtaaccggttacggtacgggtaccgttacgaccggtaccgtacgtttccgttcgtttccttccgtacgttaccccgg

SEQ ID NO: 3976 - DNA, 496 bp, Homo sapiens
  misc_feature: GYAE6OF02FWK58.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtggcagtttattacttgtcagcagtattatagtagtcctcagtactttggccggggaccagcgtggagatacgaacgaactgtggctgcaccatctgtcttcatcc

SEQ ID NO: 3977 - DNA, 510 bp, Homo sapiens
  misc_feature: GYAE6OF02I9UNW.39.31.C09.1.454.CMB.1.raw
  modified_base (499)..(499): a, c, t, g, unknown or other
  misc_feature (499)..(499): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgagatgtgctagttattactgtcagcagtattagtagtagtcctacagtacgttttcggccggggtaccaaggtcgtaggagagtacgaacgtaactgtggctgcacctatcgtntctactctccg

SEQ ID NO: 3978 - DNA, 512 bp, Homo sapiens
  misc_feature: GYAE6OF02GTJ3R.39.31.C09.1.454.CMB.1.raw
tcagtcgcactagtcacgaccggtgctcgatttagacgtctcatcaaggaaggaaggggcagcaagatggtgttgctagacccaggtcttcatttctctgttgctctggatctctggtggcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcacatcaacagcctgcagctgaagtatgtgctagtttatactgttcagctagtattatagtacgtctctagtacgttttcgggccggggtaccaagcgtaggagatacgaaacgtacgtgtacgctgcaccatctgtctcatcctcccg

SEQ ID NO: 3979 - DNA, 522 bp, Homo sapiens
  misc_feature: GYAE6OF02JFU1O.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactggcatctacccggagtccgggtcctgaccgattcagcggcagcggtctgagacagatttcactctcaccatcagcagcctgcaggctgaagatgtggctagtttatacgtgtcagcagtattagtagtagtacctctagtacgttttcgggaccggggtaccaagccgtgggagtactacgtaaacggtaactgtcggtctacgccaccgattcgtgtcttacgattcccg

SEQ ID NO: 3980 - DNA, 505 bp, Homo sapiens
  misc_feature: GYAE6OF02H0FF9.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgctcatttactggcatctacccgggagtccgggtcctgaccgattcagcggcagcgggtctgagacagatttcactctcaccatcagcagcctgcaggctgaagatgtggctagtttattacttgtcagcagtatatagtagtctctagtacgttttcgggaccggggtaccaagcgtaggagatacaaacgaactgtggctgcaccatctgtcttcattccc

SEQ ID NO: 3981 - DNA, 517 bp, Homo sapiens
  misc_feature: GYAE6OF02I9OCZ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtgctagtttattactgtcagctagtattatagtagtcctgagttacgtttgggccggggtaacaaggtcgtaggagatacgaaacgtacgtagtggctcgcactacttcctgtccttacacttcccg

SEQ ID NO: 3982 - DNA, 518 bp, Homo sapiens
  misc_feature: GYAE6OF02HWJPT.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgtttacacaggtccaacaataagaattattcgcttggtaccagcataaaaccaggacagcctcctaagttgctcatttactggcatctacccgggatccgggtccctgaccgattcagcggcagcggtctgagacagatttcactctcaccatcagcagcctgcaggctgaagatgtggcagtttatactgtcagcagtatatagtagtacctcagacttttggaccggggtaccgaaagacctggagacgtcgaaaaccgaagtacgtagggcttcggctaccgaatccttggtcctttcattccccg

SEQ ID NO: 3983 - DNA, 497 bp, Homo sapiens
  misc_feature: GYAE6OF02I2NOF.39.31.C09.1.454.CMB.1.raw
  modified_base (494)..(494): a, c, t, g, unknown or other
  misc_feature (494)..(494): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacacgggagtccggggtccctgaccgattcagcggcagcgggtctgagacagattcactctcaccatcagcagcctgcaggctgaagatgtggcagtttattactgtcagcagtattatagtagtcctcagtacttttggaccggggaccaagctggagagtacgaaacgtaactggtgctgcacatctgtctntac

SEQ ID NO: 3984 - DNA, 506 bp, Homo sapiens
  misc_feature: GYAE6OF02I3EN8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattactgtcagcagtattatagtagtcctcagtactttgggccggggtaccaagctggagactacgaaacgaactgtaggctgcacatccgtgtcttctattcccg

SEQ ID NO: 3985 - DNA, 556 bp, Homo sapiens
  misc_feature: GYAE6OF02H0PHB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaaccaggacagcctctaagttgctcatttactgggcatccgtacccgggagtccggggtccctgaccgattcagcggcagcggttctgagacagtattttcactctcaccatcagcagcctgcaggctagaagatgtggactagttttattactgtcagctaagtatatagtagtcctatagttacgtttcgggaccgggggaccaaagcgtaggagtactacgaaacgaacgttggtacggtccgtacgacccgtaacctacttccgttacgttacctttctaacctttccccg

SEQ ID NO: 3986 - DNA, 509 bp, Homo sapiens
  misc_feature: GYAE6OF02HNFGA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccgggtccctgaccgattcagcggcagcggtctgagacagatttcactctcaccatcagcagcctgcaggctgaagatgtggctagtttattactgtcagcagtattatagtagtcctctagtacgttttcggaccggggtaccaaggcgtagggagtatacgaacgaactggtagctgcacatctgtcttcattcccg

SEQ ID NO: 3987 - DNA, 496 bp, Homo sapiens
  misc_feature: GYAE6OF02INAJT.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcagctgaagatgtggcagtttattactgtcagcagtattatagtagtcctcagtacttttggccggggtacagcgtggagatcgaaacgaactgtggctgcaccatctgtcttcatccg

SEQ ID NO: 3988 - DNA, 508 bp, Homo sapiens
  misc_feature: GYAE6OF02IB5JI.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcagctgaagatgtggcagtttattacttgtcagcagtattatagtagtcctctagtacttttgggccggggaccaaggctaggagatacgaaacgaactgtggctcgcgaccatctcgtcttcattcccg

SEQ ID NO: 3989 - DNA, 584 bp, Homo sapiens
  misc_feature: GYAE6OF02JUMLT.39.31.C09.1.454.CMB.1.raw
  modified_base (292)..(292): a, c, t, g, unknown or other
  misc_feature (292)..(292): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
tcagtcgcactagtcacgaccggtgctcgatttagacgtctcatcaaggaaggaagggcgagcaagatggtgttgcagacccaggtcttcatttctctgttgctctggatctctggtgcctacggtgacatcgtgatgacccagtctccagactccctggctgtgtctctggcgagagggccaccatcaactgcaagtccagccagagtgtttacacaggtccaacaataagaattacttcgacttggtaccagcagaaaccaggacagcctcctaagttgctacatttacnggcatctacccgggagtccggggtccctgaccgattcagtcggcagccgggtntcgagacagtatttcactcncacccatcagcagcctagcaggcctgaacgtatcggtggacctaggtttaactacgttggtcctaggacctaggttaaatttagtagttaacggtcccttagaacgttaaccgtttttggggaacccgggggtaaccaacgggtcgtacgggtacaagttacccgaaacggtaaccttgggttagccgtaggtacaccgtaatcgtacgtcttacgtac

SEQ ID NO: 3990 - DNA, 520 bp, Homo sapiens
  misc_feature: GYAE6OF02I6OQD.39.31.C09.1.454.CMB.1.raw
  modified_base (381)..(381): a, c, t, g, unknown or other
  misc_feature (381)..(381): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccggggagtccggggtccctgaccgattccagcggcagcgggtctgagacagatttcactctcaccatcagcagcctgcnggctgaagatgtggctagtttattactgtcagcagtatatagtatcctcagtacgtttgggaccggggtacgaagtcgtaggagagtacgaaaccgaacgtagtggctacgacgacccagtccgtgtcttcacttcccg

SEQ ID NO: 3991 - DNA, 497 bp, Homo sapiens
  misc_feature: GYAE6OF02FF9NG.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccggagtccggggtccctgaccgattcagcggcagcgggtctgagacagatttcactctcaccatcagcagcctgcaggctgaagatgtggcagtttattactgtcagcagtattatagtagtcctcagtacttttgggccggggaccaagctggagatacaacgaactgtggctgcaccatctgtcttcattcc

SEQ ID NO: 3992 - DNA, 504 bp, Homo sapiens
  misc_feature: GYAE6OF02GK321.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtacgttttggccggggtaccaaggcgtggagatacgaaacgaactgtgctgcacactctgtcttcattccg

SEQ ID NO: 3993 - DNA, 493 bp, Homo sapiens
  misc_feature: GYAE6OF02IT3XC.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgatccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtggcagtttattactgtcagcagtattatagtagtcctcagtacttttgggccgggacaagcgtggagatcgaaacgactgtggctgcacatctagttctctac

SEQ ID NO: 3994 - DNA, 497 bp, Homo sapiens
  misc_feature: GYAE6OF02J21GE.39.31.C09.1.454.CMB.1.raw
  modified_base (364)..(364): a, c, t, g, unknown or other
  misc_feature (364)..(364): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttactgggcatctacccgggagtccggggtcctgaccgattcagcggcagcggtctgagacagatttcactctcaccntcagcagcctgcaggctgaagatgtggcagttattactgtcagcagtattatagtagtcctctagacgttttggaccggggacaagctaggagtatcgaacgactgtggctgcactatctgtcttcattcccg

SEQ ID NO: 3995 - DNA, 503 bp, Homo sapiens
  misc_feature: GYAE6OF02G2GQI.39.31.C09.1.454.CMB.1.raw
  modified_base (429)..(429): a, c, t, g, unknown or other
  misc_feature (429)..(429): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccgggtccctgaccgattcagcggcagcggtctgagacagatttcactctcaccatcagcagcctgcaggctgaagatgtggctagtttattactgtcagctagtattatagtagtcctntagtacgtttgggccgggtacaagcgtaggagatacaaacgtactgtggctgcacactctgtcttacacttccc

SEQ ID NO: 3996 - DNA, 503 bp, Homo sapiens
  misc_feature: GYAE6OF02H1B1R.39.31.C09.1.454.CMB.1.raw
  modified_base (431)..(431): a, c, t, g, unknown or other
  misc_feature (431)..(431): n is a, c, g, or t
  modified_base (499)..(499): a, c, t, g, unknown or other
  misc_feature (499)..(499): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggtgacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcattttactgggcatctacccgggagtccggggtccctgaccgattcagcggcagcggtctgagacagatttcactctcaccatcagcagcctgcaggctgaagatgtggctagtttattactgtcagcagtattatagtagtcctnagtacgttttgggccggggtacaagcgtggagatacgaaacgaactgtggctgcaccgatctgtcttntacc

SEQ ID NO: 3997 - DNA, 591 bp, Homo sapiens
  misc_feature: GYAE6OF02JQ3YG.39.31.C09.1.454.CMB.1.raw
  modified_base (365)..(365): a, c, t, g, unknown or other
  misc_feature (365)..(365): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaaagttgctcatttactgggcatctacccgggagtccggggtccctgaccgattcacgtcggcagcgggtctgagacagatttcactcncaccatcagcagcctgcagctgaagatgtggcagtttatactgtacagtaccagtacttagtagttacgtacctctacgtacgtttttcgggaccgggggtaccctaaaggtccgtagggtacgtacgtacgtaaaaccggtaaaccgttacggttacgggaccgttacggtacctaaccccgtacgttaccgttacggttacccgtttaccgaacgtttcccccg

SEQ ID NO: 3998 - DNA, 519 bp, Homo sapiens
  misc_feature: GYAE6OF02IOFM2.39.31.C09.1.454.CMB.1.raw
  modified_base (388)..(388): a, c, t, g, unknown or other
  misc_feature (388)..(388): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccggggagtccggggtccctgaccgattcagcggcagcgggtctgagacagatttcactctcaccatcagcagcctgcaggctgaanatgtggcagtttattactgtcagcagtattatagttagtcctctagtacttttgggaccggggtaccaaggcgtaggagagtacaaacggaactaggtggtctgacacctatcctggtcttctacttcccg

SEQ ID NO: 3999 - DNA, 494 bp, Homo sapiens
  misc_feature: GYAE6OF02H7KQW.39.31.C09.1.454.CMB.1.raw
  modified_base (361)..(361): a, c, t, g, unknown or other
  misc_feature (361)..(361): n is a, c, g, or t
  modified_base (429)..(429): a, c, t, g, unknown or other
  misc_feature (429)..(429): n is a, c, g, or t
  modified_base (457)..(457): a, c, t, g, unknown or other
  misc_feature (457)..(457): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactcncaccatcagcagcctgcaggctgaagatgtggctagtttattactgtcagcagtatatagtagtcctnagtacttttggccggggacaagctgganatcaaacgactagtggctgcacatctgtcttcattcc

SEQ ID NO: 4000 - DNA, 494 bp, Homo sapiens
  misc_feature: GYAE6OF02GNR6O.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggatccggggtccctgaccgattcagcggcagcgggtctgagacagatttcactctcaccatcagcagcctgcagctgaagatgtggcagttattactgtcagcagtattatagtagtcctcagtacttttggccggggaccaaagctggagatcaaacgaactgtaggctgcaccatctgtcttcatcc

SEQ ID NO: 4001 - DNA, 495 bp, Homo sapiens
  misc_feature: GYAE6OF02GB0MQ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtggcagtttattactgtcagcagtattatagtagtctcagtacgttttggccggggaccaagcgtgagatacaacgaactgtaggctgacacatctgtcttcatcc

SEQ ID NO: 4002 - DNA, 502 bp, Homo sapiens
  misc_feature: GYAE6OF02FU4FJ.39.31.C09.1.454.CMB.1.raw
  modified_base (430)..(430): a, c, t, g, unknown or other
  misc_feature (430)..(430): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattacttgtcagcagtattatagtatcctnagtacgtttgggccggggacaaggctagggagatacaaacgtactgtggctgcaccatctgtcttcattccc

SEQ ID NO: 4003 - DNA, 495 bp, Homo sapiens
  misc_feature: GYAE6OF02I4D09.39.31.C09.1.454.CMB.1.raw
  modified_base (482)..(482): a, c, t, g, unknown or other
  misc_feature (482)..(482): n is a, c, g, or t
  modified_base (492)..(492): a, c, t, g, unknown or other
  misc_feature (492)..(492): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtacgtttgggccgggtacagcgtggagatcgaaacgactgtggctgcacntctgtcttcntcc

SEQ ID NO: 4004 - DNA, 499 bp, Homo sapiens
  misc_feature: GYAE6OF02FN6YE.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattactgtcagcagtattatagtagtcctcagtacttttggccggggtaccaagctggagatcaacgaactgtggctgcaccatctgtcttcattcccg

SEQ ID NO: 4005 - DNA, 521 bp, Homo sapiens
  misc_feature: GYAE6OF02IP7JM.39.31.C09.1.454.CMB.1.raw
  modified_base (392)..(392): a, c, t, g, unknown or other
  misc_feature (392)..(392): n is a, c, g, or t
  modified_base (430)..(430): a, c, t, g, unknown or other
  misc_feature (430)..(430): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgngctagtttattactgtcagcagtattatagtagtcctnagtacgttttgggaccggggtaccaagcgtggacgtatactaaacggaacgttaggcggtcgtgaccacctatccttgtcttcacttcccg

SEQ ID NO: 4006 - DNA, 542 bp, Homo sapiens
  misc_feature: GYAE6OF02GSCIX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaaacaataagaattacttcgcttggtaccagcagaaaccaggacagcctcctaagttgctcatttactggcatccgtacccgggagtcccgggtcctgaccgatcagcggcagcggtctgagacagatttcactctcacatcagcagcctgcaggctagaagatgtggctagttattatgtcagcagtattatagtagtcctactacgtacgtttcgggaccggggtaaccaaggtcgtaggagtagtaccgaaacggtaacgtaggtaggcttacgacctaccgacgttccgtacgtccttaccgtacttacccg

SEQ ID NO: 4007 - DNA, 501 bp, Homo sapiens
  misc_feature: GYAE6OF02H99BL.39.31.C09.1.454.CMB.1.raw
  modified_base (458)..(458): a, c, t, g, unknown or other
  misc_feature (458)..(458): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccgggtcctgaccgattcgagcggcagcgggtctgagacagatttcactctcaccatcagcagcctgcaggctgaagatgtggactagtttatactgtcagctagtatattagtagtctcagtacgtttggccggggacaagctagganactacaacgaactgtggctgcaccatcttcgtcttcattcccg

SEQ ID NO: 4008 - DNA, 505 bp, Homo sapiens
  misc_feature: GYAE6OF02GJN22.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcagcgggtctgagacagatttcactctcaccatcagcagcctgcaggctgaagatgtggcagtttattactgtcagcagtattatagtagtcctcagtacttttgggccggggtaccaaggcgtggagatacgaaacgaacgtagtggctgcacatctgtcttcattcccg

SEQ ID NO: 4009 - DNA, 518 bp, Homo sapiens
  misc_feature: GYAE6OF02I90J3.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtccctgaccgattcagcggcagcgggtctgagacagtatttcactctcaccatcagcagcctgcaggctgaagatggtggctagtttattacgtgtacagcagtattatagttagtcctctagtacttttcgggccggggtaaccaagcgtggagatacgaaacgtaacgtgtacggctgacacctatctgtcttcattcccg

SEQ ID NO: 4010 - DNA, 536 bp, Homo sapiens
  misc_feature: GYAE6OF02JJTHQ.39.31.C09.1.454.CMB.1.raw
  modified_base (287)..(287): a, c, t, g, unknown or other
  misc_feature (287)..(287): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagaggccaccatcaactacaagtccagccagagtgtttacacagtccaacaataagaattactcgcttggtaccagcagaaaccaggacagcctcctaagttgctcatttacnggcatcgtaccgggagtccggggtcctggacccgtattcagtcgcagcgggtctgagacagattcactctcacatcagcagcctgcagctagacgatgtgctagtttatactgtcagcagtatactagtatccttacgagtacgttttgggacccggggtacgtaacgcgtacggaagtacgtacgaaaccgtacgtacggtacgacgtacgacaccgtataccgtgtaccttctacgttccttacccg

SEQ ID NO: 4011 - DNA, 507 bp, Homo sapiens
  misc_feature: GYAE6OF02GXCQF.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagtgctcatttactgggcatcgtacccgggagtccgggccctgaccgattcagcggcagcgggtctgagacagatttcactctcaccatcagcagcctgcaggctgaagatgtgctagtttattactgtcagcagtattatagtagtcctctagtacgtttcgggccgggaccagcgtggacgatacgaaacgaacgtgtaggtctgaccacactctgtcttcattcccg

SEQ ID NO: 4012 - DNA, 505 bp, Homo sapiens
  misc_feature: GYAE6OF02IIFCZ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaaccaggacagcctcctaagttgctcatttactgggcatctacccgggagtccggggtccctgaccgattcagcggcagcggtctgagacagatttcactctcaccatcagcagcctgcaggctgaagatgtggctagtttattactgtcagcagtatatagtagtctacagtacttttggccgggtaccgaagctaggagagtacaacgaactgtaggctgacacctactctgtcttcattccg

SEQ ID NO: 4013 - DNA, 502 bp, Homo sapiens
  misc_feature: GYAE6OF02FYUKM.39.31.C09.1.454.CMB.1.raw
  modified_base (427)..(427): a, c, t, g, unknown or other
  misc_feature (427)..(427): n is a, c, g, or t
  modified_base (459)..(459): a, c, t, g, unknown or other
  misc_feature (459)..(459): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttgtaccagcagaaaccaggacagcctcctaagttgctcatttactgggcatctacccgggagtccggggtccctgaccgattcagcggcagcgggtctgagacagatttcactctcacatcagcagctgcagctgaagatgtggctagttattactgtacagcagtattatagtagtcctnagtcgttttgggccggggaacaaggctagganatacaaacgaactggtcgctgcgacagtctgtcttcattcccg

SEQ ID NO: 4014 - DNA, 505 bp, Homo sapiens
  misc_feature: GYAE6OF02G44GY.39.31.C09.1.454.CMB.1.raw
  modified_base (429)..(429): a, c, t, g, unknown or other
  misc_feature (429)..(429): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcagcggtctgagacagatttcactctcaccatcagcagcctgcaggctagaagatgtggctagtttattactgtcagcagtattatagtagtcctntagtacgtttgggccggggtacctaagcgtaggagtatacgaacgaactgtggctgacactatctgtcttcatccg

SEQ ID NO: 4015 - DNA, 502 bp, Homo sapiens
  misc_feature: GYAE6OF02H61SX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcaagaaaccaggacagcctcctaagttgctcattactggcatctacccgggagtccgggtccctgaccgattcagcggcagcggtctgagacagatttcactctcaccatcagcagcctgcaggctgaagatgtgctagtttattactgtcagctagtattaatagtagtcctcagtactttggaccggggtaccaagcgtaggagatacgaaacgaactagtggctgcacatctgtcttcatccg

SEQ ID NO: 4016 - DNA, 556 bp, Homo sapiens
  misc_feature: GYAE6OF02I61LI.39.31.C09.1.454.CMB.1.raw
  modified_base (448)..(448): a, c, t, g, unknown or other
  misc_feature (448)..(448): n is a, c, g, or t
  modified_base (546)..(546): a, c, t, g, unknown or other
  misc_feature (546)..(546): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactaccctggctgtgtctctgggcgaggagggtccaccatcaacgtgcaagtccagccagagttgttttacacacggtccaacaataagaattacttcgtcttggtaccagcagaaaccaggacagcctcctaagttgctcatttacgtgggcatcgtacccgggagtcccggggtccctgaccgtattcagcggcgaggcggtctgagacagatttcactctcaccatcagcagcctgcaggctagaagatgtggctagtttatacgtgtcagctagtattatagttacgtcctanagttacgttttcgggacccggggtaactaaggctagggagtactacgaaaacgtaacttaggcggtcgtacgacctacgtacttcgttacgtcttacntttacccccg

SEQ ID NO: 4017 - DNA, 520 bp, Homo sapiens
  misc_feature: GYAE6OF02G51YV.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtccctgaccgattcagcggcagcggtctgagacagatttcactctcaccatcagcagcctgcaggctgaagatgtggctagtttattaactgtcagctaagtattaatagttacgtcctacagtacgttttcgggccggggaaccaagcgtggagtatacgaaacgtaactgtaggctgacaccactctcgtcttcacttcccg

SEQ ID NO: 4018 - DNA, 502 bp, Homo sapiens
  misc_feature: GYAE6OF02H6C1S.39.31.C09.1.454.CMB.1.raw
  modified_base (479)..(479): a, c, t, g, unknown or other
  misc_feature (479)..(479): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaaataagaattacttcgcttggtaccagcagaaaccaggacagcctcctaagttgctcatttactgggcatctacccggagtccgggtccctgaccgattcagcggcagcgggtctgagacagatttcactctcacatcagcagcctgcaggctgaagatgtgctagtttattactgtcagcagtattatagtatcctcagtacgtttgggaccggggaccaacgcgtaggagagtacaaacgaacttgnggctgcacatctgtcttcattcc

SEQ ID NO: 4019 - DNA, 546 bp, Homo sapiens
  misc_feature: GYAE6OF02JH19O.39.31.C09.1.454.CMB.1.raw
  modified_base (386)..(386): a, c, t, g, unknown or other
  misc_feature (386)..(386): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctaccggagtccgggtcctgaccgattcagcggcagcggtctgagacagatttcactctcaccatcagcagcctgctagctgaagatgngtcagttattacgtgtcagctaagtattatagtagtcctacgtagtacgttttgggacccggggtacaaggtaccgttaggagtacgtacgaaacggtaaacgttcggtaggtaccgttcgacgtaacccagttacctacggtcctttacgacttccccg

SEQ ID NO: 4020 - DNA, 581 bp, Homo sapiens
  misc_feature: GYAE6OF02IPK7N.39.31.C09.1.454.CMB.1.raw
  modified_base (567)..(567): a, c, t, g, unknown or other
  misc_feature (567)..(567): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctcgtgggcgagagggccacatcaactgcaagtccagccagagttgttttacacaggtaccaacaataagaattacttcgcttggtaccagcaagaaaccaggacagcctacctaagttgctctatttacgtgggctatccgtacccggggaggtcccggggtccctggaccgtattcgaggcggcgaggccgggtctaggagacagtactttcactctcaccatcagcagcctgcaggctagaagagtgtggctagtttattacgttgtacagctaagttatttaagtagttacgttacctacgtaacgttaccggttttcggggacccggggtaaccaaggtcgtaggtaacgtagtaaccgaaacgtaacgtaggtcggactgaccacctatccgtntcttctacttcccg

SEQ ID NO: 4021 - DNA, 528 bp, Homo sapiens
  misc_feature: GYAE6OF02GQ4A6.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttacngggcatctacccgggagtccggggtcctgaccgattcagcggcagcggtctgagacagatttcactctcaccatcagcagcctgcaggctgaagatgtggcagtttattactgtcagctagtatttaatagttacgtacctactagtacgttttcgggccggggtaaccaaggcgtaggagtactacgaaacgtaacgtgtaggtctacgcacctactcttgtcttacctattcccg

SEQ ID NO: 4022 - DNA, 514 bp, Homo sapiens
  misc_feature: GYAE6OF02GQ1HE.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctctaagttgctcatttactgggcatctacccgggagtccggggtccctgaccgattcagcggcagcgggtctgagacagatttcactctcaccatcagcagcctgcaggctgaagatggtggcagtttattacgtgtcagcagttattatagtagtcctcagtacgttttggccggggtaccaagcgtggagagtacgaaacgaacgtgtaggtctgcctaccactcttcgtcttcattcccg

SEQ ID NO: 4023 - DNA, 519 bp, Homo sapiens
  misc_feature: GYAE6OF02H248G.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattacttgtcagctagtattatagtacgtctcagtacgttttggaccggggtaccaagcgtaggagatacgaaacgaactggtacggcgtgcaccatcgtcgttcttcctattccccg

SEQ ID NO: 4024 - DNA, 533 bp, Homo sapiens
  misc_feature: GYAE6OF02HXP1C.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtacgttttgggccggggtaccgaaaggccgtagggacgtagtacgaaacggtaactcggtagggcgtggaccaccacttcctcggttcttacctattcccg

SEQ ID NO: 4025 - DNA, 494 bp, Homo sapiens
  misc_feature: GYAE6OF02GURAA.39.31.C09.1.454.CMB.1.raw
  modified_base (429)..(429): a, c, t, g, unknown or other
  misc_feature (429)..(429): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattactgtcagcagtattatagtagtcctnagacttttggccggggaccaagctggagatcaaacgaactgtggctgcaccatctgtcttcatcc

SEQ ID NO: 4026 - DNA, 562 bp, Homo sapiens
  misc_feature: GYAE6OF02JUSA0.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaacaataagaattacttcgcttggtaccagcagaaccaggacagcctctaagttgctcatttacgngggcatccgtacccgggagtccggggtcctgaccgattcagcggcaggcggtctgagacagtactttcactctccaaccatcagcagcctgacaggctagaagagtgtggactagtttattacgtgtacagtactagttattatagtacgtcctacgtacgtcgttttacgggaccggggtacctaaggccgttaggacgtacgtacgaaaccggtacgtacggtggtactagacctactacgttaccgtgtttccttactacttacccg

SEQ ID NO: 4027 - DNA, 512 bp, Homo sapiens
  misc_feature: GYAE6OF02I804C.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttactgggcatcctacccgggagtccggggtccctgaccgattcagcggcagcggtctgagacagatttcactctcaccatcagcagcctgcaggctgaagatgtggctagtttattacttgtcagctagtattatagtagtcctcagtacgtttcggaccggggtacaagcgtggagagtacgaaacgtaacgtgtaggctgacacatctgtcttcgtattcccg

SEQ ID NO: 4028 - DNA, 514 bp, Homo sapiens
  misc_feature: GYAE6OF02JC16Y.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccggagtccgggtccctgaccgattcagcggcagcggtctgagacagatttcactctcaccatcagcagcctgcaggctagaagatgtggctagtttattactgtcagcagtatatagtagtctcagtacttttcgggccggggtaacaacggcgtggacgagtacgaaacgtaactagtggactgacacctatacctgtacttcattcccg

SEQ ID NO: 4029 - DNA, 504 bp, Homo sapiens
  misc_feature: GYAE6OF02GINHQ.39.31.C09.1.454.CMB.1.raw
  modified_base (430)..(430): a, c, t, g, unknown or other
  misc_feature (430)..(430): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtcctgaccgattcagcggcagcgggtctgagacagatttcactctcaccatcagcagcctgcaggctgaagatgtggctagtttattactgtcagtcagtattatagtagtcctntagtacgttttgggccggggaacagctggagatacgaaacgaactgtcggctgcacatcgtgtcttcattcccg

SEQ ID NO: 4030 - DNA, 527 bp, Homo sapiens
  misc_feature: GYAE6OF02JMZEM.39.31.C09.1.454.CMB.1.raw
  modified_base (332)..(332): a, c, t, g, unknown or other
  misc_feature (332)..(332): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacagtccaacaataagaattactcgcttggtaccagcagaaaccaggacagcctcctaagtgctcattactggcatctaccggagtccgggcctgaccgattcagcggcagcggtntgagacagattcactctcacctatcagcagcctgacnggctgacgatgngctagtttatactgtacagcagtatatagttacgtactacgagttacgtttcgggaccggggtaacaagtcgtaggtaacgagtacaaacgtaaccgtggtacggccgtgacgtacctacgtcgttcggtacttaccgattacccg

SEQ ID NO: 4031 - DNA, 503 bp, Homo sapiens
  misc_feature: GYAE6OF02FZR7B.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtacgttttggccggggtaccaagcgtggagatacaaacgaactgtggctgcacatcctgtcttcattccg

SEQ ID NO: 4032 - DNA, 522 bp, Homo sapiens
  misc_feature: GYAE6OF02GIJM5.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcagctgaagatgtggctagtttattactgtcagcagtattatagttagtcctctagtacgttttcgggaccggggtacaaggtcgtgggaagactacgaaacgtaacgtagtcggactgacactatcgttgtcttacattcccg

SEQ ID NO: 4033 - DNA, 571 bp, Homo sapiens
  misc_feature: GYAE6OF02ISX45.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactggcatctacccgggagtcccgggtccctgaccgattcagcggcagcgggtctgagacagtatttcactctcacatcagcagcctgcgaggctgaagagtgtgtctagtttacttactgtcagctagttattatagttacgtccttacgtagtaacgttttcgggacccggggtaacaacggtcgtagggacgtataccgaaaacggtaaccgttaggtcggtaccgttacgaccgtaacccgtacgtccttacggttacctttaccgtacgtttaccccg

SEQ ID NO: 4034 - DNA, 506 bp, Homo sapiens
  misc_feature: GYAE6OF02G7CJO.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattacttgtcagcagtattatagtagtcctcagtacttttgggccggggaccaaggctaggagatcgaaacgaactgtggctgcaccatcctgttcttcattcccg

SEQ ID NO: 4035 - DNA, 493 bp, Homo sapiens
  misc_feature: GYAE6OF02GHX5X.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagttattactgtcagcagtattatagtagtcctcagtacttttggccggggtacaagctggagatcaacgaactgtggctgcacatctgtcttcatcc

SEQ ID NO: 4036 - DNA, 497 bp, Homo sapiens
  misc_feature: GYAE6OF02FO9YB.39.31.C09.1.454.CMB.1.raw
  modified_base (392)..(392): a, c, t, g, unknown or other
  misc_feature (392)..(392): n is a, c, g, or t
  modified_base (431)..(431): a, c, t, g, unknown or other
  misc_feature (431)..(431): n is a, c, g, or t
  modified_base (461)..(461): a, c, t, g, unknown or other
  misc_feature (461)..(461): n is a, c, g, or t
  modified_base (484)..(484): a, c, t, g, unknown or other
  misc_feature (484)..(484): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgngcagtttattactgtcagctagtattatagtagtcctanagtactttggaccggggaccaagcgtgganatcaaacgaactgtggctgcacntctgtcttcatcc

SEQ ID NO: 4037 - DNA, 550 bp, Homo sapiens
  misc_feature: GYAE6OF02JLX80.39.31.C09.1.454.CMB.1.raw
  modified_base (287)..(287): a, c, t, g, unknown or other
  misc_feature (287)..(287): n is a, c, g, or t
  modified_base (318)..(318): a, c, t, g, unknown or other
  misc_feature (318)..(318): n is a, c, g, or t
  modified_base (487)..(487): a, c, t, g, unknown or other
  misc_feature (487)..(487): n is a, c, g, or t
  modified_base (529)..(529): a, c, t, g, unknown or other
  misc_feature (529)..(529): n is a, c, g, or t
tcagtcgcactagtcacgaccggtgctcgatttagacgtctcatcaaggaaggaagggcgagcaagatggtgttgcagacccaggtcttcatttctctgttgctctggatctctggtgcctacgggacatcgtgatgacccagtctccagactccctggctgtgtctctggcgagagggccaccatcaactgcaagtccagccagagttgtttacacaggtccaacaataagattactcgcttggaccagcagaaaccaggacagcctactaagtgctcatttacgnggcatcctaccgggagtccgggtcctgaccnttcacgcggacagcgggtcctggaacgcagtatttcgacttcgtacacctatccgagcagtccctgctaggctgaacgtgtgtggctagttattacgtgtcaacggcagtacttagttagtacgtcctacgtagtacgtttacgggaccggggtaccagaccgtggaanacgtacgaacgtaacgtgcggtactcgtacgtaccgaagttntaaccgttcgttcacttcccg

SEQ ID NO: 4038 - DNA, 501 bp, Homo sapiens
  misc_feature: GYAE6OF02IKUY9.39.31.C09.1.454.CMB.1.raw
  modified_base (292)..(292): a, c, t, g, unknown or other
  misc_feature (292)..(292): n is a, c, g, or t
  modified_base (485)..(485): a, c, t, g, unknown or other
  misc_feature (485)..(485): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtccctgaccgattcagcggcagcgggtctgagacagatttcactctcaccatcagcagcctgcaggctgaagatgtggctagtttattactgtcagctagtattatagttagtcctcagtacgtttgggccggggacaagctggagatacaacgactgtggctgcaccntctgtcttcattcccg

SEQ ID NO: 4039 - DNA, 549 bp, Homo sapiens
  misc_feature: GYAE6OF02GTKNH.39.31.C09.1.454.CMB.1.raw
  modified_base (223)..(223): a, c, t, g, unknown or other
  misc_feature (223)..(223): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
  modified_base (518)..(518): a, c, t, g, unknown or other
  misc_feature (518)..(518): n is a, c, g, or t
  modified_base (532)..(532): a, c, t, g, unknown or other
  misc_feature (532)..(532): n is a, c, g, or t
  modified_base (547)..(547): a, c, t, g, unknown or other
  misc_feature (547)..(547): n is a, c, g, or t
tcagtcgcactagtcacgaccggtgctcgatttagacgtctcatcaaggaaggaagggacgagcaagatggtgttgcagaccaggtcttcattctctgttgctctgatctctggtgcctacgggacgatcgtgatgacccagtctccagactccctggctgtgtctctgggcagaggcctaccatcaactgcaagtccagccagatgtttacacaggtccaanaataagaattacttcgcttgtaccagcagaaccaaggaacagtacctctaaacttgctcactttaactgggccagtcctaaccggacgtccggggtccctcgaccgattacaggtcgcacggcgggccttggaacgcaaggacttttacgaccttcactaccacgtacacgcacggaccctgccgagcgtnaaagatcggngctagttattacgctcagacatatagtcgtagtcctacaagttcgttgggccgggtaaccagtctggagatacgaaaccgtaacgtgtcgtcgngacctaccagttcnggtttctaccgtacncg

SEQ ID NO: 4040 - DNA, 500 bp, Homo sapiens
  misc_feature: GYAE6OF02F88FA.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacngggcatctacccgggagtccggggtccctgaccgattcagcggcagcgggtctgagacagatttcactctcaccatcagcagcctgcagctgaagatgtggctagtttattacttgtcagcagtattatagtagtcctcagtactttgggccggggtaccaagcgtggagatacaaacgaactgtggctgacacatctgtcttcatccc

SEQ ID NO: 4041 - DNA, 523 bp, Homo sapiens
  misc_feature: GYAE6OF02F22PN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtcctgaccgattcagcggcagcgggtctgagacagatttcactctcaccatcagcagcctgcaggctgaagatgtggctagtttattactgtcagctagtatttatagttagtcctcgtagtacgttttagggcccggggtaaccaaggtcgtaggagagtacaaacgtaactaggtacggctgacaccatcctgtcttctattcccg

SEQ ID NO: 4042 - DNA, 509 bp, Homo sapiens
  misc_feature: GYAE6OF02IDK27.39.31.C09.1.454.CMB.1.raw
  modified_base (296)..(296): a, c, t, g, unknown or other
  misc_feature (296)..(296): n is a, c, g, or t
  modified_base (407)..(407): a, c, t, g, unknown or other
  misc_feature (407)..(407): n is a, c, g, or t
  modified_base (429)..(429): a, c, t, g, unknown or other
  misc_feature (429)..(429): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacggggacatcgtgatgacccagtctccagactccctggctgtgtctctggcgagagggccacatcaactgcaagtccagccagagtgttttacacaggtccaacaataagaattacttcgacttggtaccaagcaagaaaaccaggacagcctcctaaagttgctcatttacngggcatcctacccggagtccgggccctgaccgattcagcggcagcggtctgagacagatttcactctcaccatcagcagcctgcaggctgaagatcgtgctagtttatacngtcagcagtatatagtagtctnagtactttgggccgggtaccaagcctaggagatacgaacgaactgtggcctaggccactatcctggttacctctatcccg

SEQ ID NO: 4043 - DNA, 509 bp, Homo sapiens
  misc_feature: GYAE6OF02F9LPL.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattacttgtcagcagtattatagtagtcctctagtacgttttgggaccggggtaccaaggcgtaggagatacaacgtaacgtgtggctgcaccatctgtcttcattccc

SEQ ID NO: 4044 - DNA, 499 bp, Homo sapiens
  misc_feature: GYAE6OF02IH2OA.39.31.C09.1.454.CMB.1.raw
  modified_base (387)..(387): a, c, t, g, unknown or other
  misc_feature (387)..(387): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccgggagtccgggtcctgaccgattcagcggcagcgggtctgagacagatttcactctcaccatcagcagcctgcaggctagaagntgtgctagtttattactgtcagcagtatatagtagtcctacagtacgtttcggccggggacaagcgtagagatacgaacgtactgtggctgacactatctgtcttcatcccg

SEQ ID NO: 4045 - DNA, 513 bp, Homo sapiens
  misc_feature: GYAE6OF02INDF8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctctagtacgtttgggccggggtaccaagcgtaggagatacgaaacgaacgtagtggctgacaccactcgtgtcttctattcccg

SEQ ID NO: 4046 - DNA, 519 bp, Homo sapiens
  misc_feature: GYAE6OF02G4T6X.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctagaagatgtggctagtttattactgtcagcagtatatagtagtcctagtagtacgtttcgggaccggggtaccaagtcgtaggagtatacgaaacgtaacgtgtcggcgtacgcacctatctgtcttcacttcccg

SEQ ID NO: 4047 - DNA, 508 bp, Homo sapiens
  misc_feature: GYAE6OF02IOORJ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcgtacccgggagtccggggtccctgaccgattcagcggcagcggtctgagacagatttcactctacaccatcagcacgcctgcagctagaagatgtgctagttattactgtcagtcagtattatagtagtcctactagtacgtttcggccggggtaccgagcgtagagatacgaacgaactgtggctgacacatctcgtcttctatcccg

SEQ ID NO: 4048 - DNA, 506 bp, Homo sapiens
  misc_feature: GYAE6OF02GL5NA.39.31.C09.1.454.CMB.1.raw
  modified_base (493)..(493): a, c, t, g, unknown or other
  misc_feature (493)..(493): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcctacccgggagtccggggtccctgaccgattcagcggcagcgggtctgagacagatttcactctcaccatcagcagcctgcaggctgaagatgtggctagtttattactgtcagcagtattatagttagtcctctagtacgtttgggccggggtacaggcgtaggagtagtacgaacgtaactgtggctgcacntctgtcttcatcc

SEQ ID NO: 4049 - DNA, 506 bp, Homo sapiens
  misc_feature: GYAE6OF02HGXQA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtggctagtttattactgtcagcagtattatagtacgtctcagtacgttttggaccggggaccaagcgtaggagagtacaacgaactgtggctcgcaccatctgtcttctattcccg

SEQ ID NO: 4050 - DNA, 510 bp, Homo sapiens
  misc_feature: GYAE6OF02IXOVA.39.31.C09.1.454.CMB.1.raw
  modified_base (354)..(354): a, c, t, g, unknown or other
  misc_feature (354)..(354): n is a, c, g, or t
  modified_base (502)..(502): a, c, t, g, unknown or other
  misc_feature (502)..(502): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagtgctcatttactggcatctacccgggagtccgggtcctgaccgattcagcggcagcggtctgagacagatttcactntcgaccatcagcagcctgcagctgaagatgtgctagtttatacgtgtcagcagtatatgtagtctacgtagtacgtttaggaccggggacaagcgtagagagtacgaaacgacgtagtggactagacaaccgattcctcgtacttacncttacccg

SEQ ID NO: 4051 - DNA, 508 bp, Homo sapiens
  misc_feature: GYAE6OF02H60PX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcacggctgaagatgtggctagtttattactgtcagctagtatatagtagtcctcagtacgttttgggccggggtaccaagcgtggagatacgaaacgactagtggctgacacatctgtcttcattcccg

SEQ ID NO: 4052 - DNA, 508 bp, Homo sapiens
  misc_feature: GYAE6OF02I7R8U.39.31.C09.1.454.CMB.1.raw
  modified_base (491)..(491): a, c, t, g, unknown or other
  misc_feature (491)..(491): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcggtctgagacagatttcactctacaccatcagcagcctgcaggctgaagatgtggctagtttattactgtcagcagtattagtagtagtcctctagtacgttttcgggaccggggacaagcgtagagactacgaacgtaactgtgctagcacnctctgtcttcattcccg

SEQ ID NO: 4053 - DNA, 517 bp, Homo sapiens
  misc_feature: GYAE6OF02FQ7JY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctagaagatgtggactagtttattactgtcagcagtattatagtactctcagtacgtttggccgggacagcgtaggagactacgaacgtaactggtacgcgtcgacacctacttaccttgttccttacacttccccg

SEQ ID NO: 4054 - DNA, 625 bp, Homo sapiens
  misc_feature: GYAE6OF02I6NJL.39.31.C09.1.454.CMB.1.raw
  modified_base (186)..(186): a, c, t, g, unknown or other
  misc_feature (186)..(186): n is a, c, g, or t
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
tcagtcgcactagtcacgaccggtgctcgatttagacgtctcatcaaggaaggaagggcgagcaagataggtgttgcagaccaggtcttcatttctctgttgctctggatctctggtgcctacgggacgatcgtgatgacccagtctccagactccctggctgtgtctctgggcgaagaggccacntcaactgcaagtccagccagattgtttacncaggtccaacataagaatacttcgacttggtaccagcanaaaccaggacagcctctaagttgactcaatttcgaggctagtcctaccgggattccggggtaccttcgaccgtattccgagtccggcaggccgggtcttacgagtaccaggtaactttcgaacttctacaactactccaaggcaacgtccgtatccgaggactagaacgtagtacggtcgtaccgtaagttttacttaacgttgtcctaacgccgtaagttagtttaacttaggtacgttacctcgtaacgtccttttacggggaaccgggtaccgtaaagaccggttggaactacgttacaaaccggtacgttaaggtcgtcgtacgttcgaacccttagtacccgttgtacgttacgtactttacccg

SEQ ID NO: 4055 - DNA, 503 bp, Homo sapiens
  misc_feature: GYAE6OF02HMP93.39.31.C09.1.454.CMB.1.raw
  modified_base (388)..(388): a, c, t, g, unknown or other
  misc_feature (388)..(388): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttactgggcatcgtacccgggagtccgggtccctgaccgattcagcggcaggcggtctgagacagatttcactctcaccatcagcagcctgcaggctgaagntgtggctagtttattactgtcagcagtatatagtacgtcctcagtacgtttcgggccggggacaagcgtaggagactacaacgaactgtgctgacacatctgtcttctattcccg

SEQ ID NO: 4056 - DNA, 499 bp, Homo sapiens
  misc_feature: GYAE6OF02HU3GB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggatccggggtccctgaccgattcagcggcagcgggtctgagacagatttcactctcaccatcagcagcctgcaggctgaagatgtggcagtttattactgtcagcagtattatagtagtcctcagtacgttttggccggggtacaagctggagatacgaaacgaactgtggctgcacatctgtcttcattccg

SEQ ID NO: 4057 - DNA, 506 bp, Homo sapiens
  misc_feature: GYAE6OF02HC37Z.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtcccggggtcctgaccgattcagcggcagcgggtctgagacagatttcactctcaccatcagcagcctgcaggctgaagatgtggctagtttattactgtcagcagttattatagtagtcctcagtacgtttgggccggggtaccagcgtggagatacgaacgaactgtaggctgcaccatctgtcttcacttcccg

SEQ ID NO: 4058 - DNA, 525 bp, Homo sapiens
  misc_feature: GYAE6OF02F9HAA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcgtacccggagtccgggtcctgaccgattcagcggcagcggtctgagacagatttcactctcacatcagcagcctgcagctagaagatgtggctagtttattactgtcagcagtattatagtagtcctagtacgtacgtttgggaccggggtaacacggctagggagtacgtacgaaacgtaacgtggtacggactcgacacgtactaccgttgtccttcattcccg

SEQ ID NO: 4059 - DNA, 501 bp, Homo sapiens
  misc_feature: GYAE6OF02INSI0.39.31.C09.1.454.CMB.1.raw
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttnctcatttacngggcatcacccgggagtccggggtccctgaccgattcagcggnagcggtctgagacagatttcactctcaccatcagcacgcctgcagctagaagatgtggctagtttattactgtcagctagtatatagtatcctnagtacgtttggccgggacaagcgtagganatacaacgaacttggtgctgacacatctgtacttcattcccg

SEQ ID NO: 4060 - DNA, 499 bp, Homo sapiens
  misc_feature: GYAE6OF02IK9KE.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtggctagttattactgtcagcagtattatagtagtcctcagtacgtttggaccggggtacaacgcgtggagatacaaacgaactagtggctgcaccatctgtcttcatcc

SEQ ID NO: 4061 - DNA, 512 bp, Homo sapiens
  misc_feature: GYAE6OF02HONSD.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttactgggcatctacccgggagtccggggtcctgaccgattcagcggcagcgggtctgagacagatttcactctcaccatcagcagcctgcaggctgaagatgtggctagtttattactgtcagcagtattatagtagtcctcgagtacgtttcggccggggaccaaggcgtaggagtactacgaaacggtaactggtggctcgacaccatctgtcttcattcccg

SEQ ID NO: 4062 - DNA, 525 bp, Homo sapiens
  misc_feature: GYAE6OF02FWNMC.39.31.C09.1.454.CMB.1.raw
  modified_base (289)..(289): a, c, t, g, unknown or other
  misc_feature (289)..(289): n is a, c, g, or t
  modified_base (357)..(357): a, c, t, g, unknown or other
  misc_feature (357)..(357): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctctaagttgctcatttacngggcatctacccggagtccggggtcctgaccgattcagcggcagcggtctgagacagactttcactcncaccatcagcagcctgcaggctgaagatgtggactagttattactgtcagctagtattatagtagtacctactagtacgtttcgggccggggtaacaaggtcgtaggagtacgtacgaaacgtacgtagtcggtctagaccaccgtactccgtgtcttacattacccg

SEQ ID NO: 4063 - DNA, 524 bp, Homo sapiens
  misc_feature: GYAE6OF02H2AXX.39.31.C09.1.454.CMB.1.raw
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (439)..(439): a, c, t, g, unknown or other
  misc_feature (439)..(439): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcaagaaaccaggacagcctcctaagttgctcatttactgggcatctacccggggagtcccggggtccctgaccgattcagcggcagcgggtctgagacagattttcactctcaccatcagcagcctgcaggctgaagntggngctagtttattactgtcagctagtattatagtacgtcctanagttacgtttcggggaccggggaccaaggtcgtaggagatacgaacgatggtggctcgcaccattcctgttccttcgacttcccg

SEQ ID NO: 4064 - DNA, 503 bp, Homo sapiens
  misc_feature: GYAE6OF02G6ZJ0.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtcccggggtccctgaccgattcagcggcagcggtctgagacagatttcactctcaccatcagcagcctgcaggctgaagatgtggctagtttattacttgtcagcagtattatagtagtcctcagtacgttttgggcccggggaacaagcgtggagatcaacgaactgtggctgcactatctgtcttcattccg

SEQ ID NO: 4065 - DNA, 523 bp, Homo sapiens
  misc_feature: GYAE6OF02GVPGO.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggactagtttattacgtgtacagtcagtattatagtagtcctctagtacgtttaggccggggtaccaagcgtggagatacgaaacgtaacgtgtaggtctcgcacctacttcctgttccttcgtattcccg

SEQ ID NO: 4066 - DNA, 504 bp, Homo sapiens
  misc_feature: GYAE6OF02G1I4V.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcctacccgggagtccggggtccctgaccgattcagcggcagcgggtctgagacagatttcactctcaccatcagcagcctgcaggctgagatgtggctagtttattactgtcagcagtattatagtagtcctatagtacgtttcggccggggacagctggagtacgtacaaacgtactggtgctgcactatctgtcttcattcccg

SEQ ID NO: 4067 - DNA, 510 bp, Homo sapiens
  misc_feature: GYAE6OF02G4BJD.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagattttcactctcaccatcagcagcctgcaggctgaagatgtggctagtttattactgtcagcagtattatagtagtcctctagtacgttttcgggccggggaccaagctggagactacgaacgaactgtggctgcacctatcctgtcttcacttcccg

SEQ ID NO: 4068 - DNA, 524 bp, Homo sapiens
  misc_feature: GYAE6OF02G0MN8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagttatatagtagtcctcgagtacgtttgggcccggggtaccagtcgtaggagtacgtacgaaacgaactcggtggcgtacgacaccgtactacgttcgtcttcattcccg

SEQ ID NO: 4069 - DNA, 513 bp, Homo sapiens
  misc_feature: GYAE6OF02IFEE7.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcgtacccgggagtccggggtccctgaccgattcagcggcagcgggtctgagacagatttcactctcaccatcagcagcctgcaggctagaagatgtggctagtttattacttgtcagcagtattatagtagtcctctagtacgttttggccggggtaaccgaagcgtaggagatacgaaacgaactgtggctgacaccatctgtcttcattcccg

SEQ ID NO: 4070 - DNA, 529 bp, Homo sapiens
  misc_feature: GYAE6OF02GWUTQ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcaggcgggtctgagacagatttcactctcaccatcagcagcctgcaggctgaagatgtggctagtttatactgtcagcagtattatacgtagtccttcgagtacgttttcgggccggggtaaccaaggtcgtaggagtatacgaaacggtaactggtacggcgtaggacaacgtactccgtgtcttacattcccg

SEQ ID NO: 4071 - DNA, 581 bp, Homo sapiens
  misc_feature: GYAE6OF02JXYFH.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactacgcttggtaccagacagaaaccaggacagcctcctaagttgctcatttacngggcatctacccgggagtccggggtcctgaccgattcagcggcagcgggtctgagacagatttcactctcaccatcagcagcctgcacggctagaagatggtcggactagttattacttgtctagactagtattagtagttagtccttacgtaacgtacggttttcgggacccggggtaccgtaaggccgtagggtaactagtaaccgaaaccggtaacgtacgggttacggaccgtacggtaccgtaaccgtacgttaccttcggttacttacccgtatttaccccg

SEQ ID NO: 4072 - DNA, 525 bp, Homo sapiens
  misc_feature: GYAE6OF02HZSP7.39.31.C09.1.454.CMB.1.raw
  modified_base (292)..(292): a, c, t, g, unknown or other
  misc_feature (292)..(292): n is a, c, g, or t
  modified_base (343)..(343): a, c, t, g, unknown or other
  misc_feature (343)..(343): n is a, c, g, or t
  modified_base (468)..(468): a, c, t, g, unknown or other
  misc_feature (468)..(468): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttacacaggtccaaacaataagaattacttcgcttggtaccagcagaaaccaggacagcctcctaagttgctcatttacnggcatctacccgggagtccgggtcctgaccgattcagcgcagcggtctganacagatttcactctcacatcagcagctgcaggctagagatgtggactagtttactatgtacagacgtatataatagtacgtacctcgacgttacgtttcgggaccggggtaccaagccgtagganacgtacgaaacgtacgtagtggcttacgacacacttcgtacgttcttacattacccg

SEQ ID NO: 4073 - DNA, 521 bp, Homo sapiens
  misc_feature: GYAE6OF02J0BBC.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttacgcttggtaccagcagaaaccaggacagcctcctaagttgctcatttactgggcatctacccggagtccggggtccctgaccgattcagcggcagcggtctgagacagatttcactctcaccatcagcagcctgcaggctgaagatgtggctagtttattactgtcagcagtattatagtagtcctcagtacttttagggccggggtaccaaaggtctagggacgatacaaacgaacgtgtacggtcttgacaccgactctcgttcttactattcccg

SEQ ID NO: 4074 - DNA, 521 bp, Homo sapiens
  misc_feature: GYAE6OF02HYODK.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctcatttactgggcatctacccgggagtccgggtccctgaccgattcagcgcagcgggtctgagacagatttcactctcaccatcagcagcctgcaggctagaagatgtggctagtttattactgtcagcagtatatagtagtcctctagtacgttttcggccggggtaccaagcgtagggagagtacgaaacgaacgtgtacggcgtcgacaccgatccgttgttcttctattcccg

SEQ ID NO: 4075 - DNA, 511 bp, Homo sapiens
  misc_feature: GYAE6OF02GNGOI.39.31.C09.1.454.CMB.1.raw
  modified_base (429)..(429): a, c, t, g, unknown or other
  misc_feature (429)..(429): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcagctgaagatgtggcagtttattactgtcagctagtattatagtagtcctntagtacttttcggccggggtaccgaagcgtaggagacgtacaaacgtaactagtggctcgcaccactcgtgtcttcattccg

SEQ ID NO: 4076 - DNA, 544 bp, Homo sapiens
  misc_feature: GYAE6OF02IJGUA.39.31.C09.1.454.CMB.1.raw
  modified_base (350)..(350): a, c, t, g, unknown or other
  misc_feature (350)..(350): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataaagaattacttcgcttggtaccagcagaaaccaggacagcctacctaagttgctcatttactgggcatctacccgggagtcccggggtcctgaccgattcagcggcagcgggtctganacagatttcactctcaccatccagcagcctgcaggctgaacgatgtcggactagtttacgttacttgtcagctaagttatattagtacgtccttacgacgtacttttacgggaccggggaaccgaaggtccgtaggagactacgaaacggaactaggtacggacttagcaccatccgttgtcttcgtattcccg

SEQ ID NO: 4077 - DNA, 510 bp, Homo sapiens
  misc_feature: GYAE6OF02HL75C.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtccctgaccgattcagcggcagcgggtctgagacagatttcactctcaccatcagcagctgcaggctgaagatgtggctagtttattacttgtcagcagtattatagtagtcctacagtacgttttgggaccggggtaccaagcgtaggagatacaaacgaactgtggctgacaccatctgtccttcattcccg

SEQ ID NO: 4078 - DNA, 544 bp, Homo sapiens
  misc_feature: GYAE6OF02G9XRI.39.31.C09.1.454.CMB.1.raw
  modified_base (298)..(298): a, c, t, g, unknown or other
  misc_feature (298)..(298): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctggcgaggaggccgaccaagtccgaactgacaagtccagccagagtgttttacacaggtccaacaataagaattacttcgcttggtaccagcaagaaaccaggacagcctcctaagttgctcatttacngggcatccgtacccgggacgtccggggtccctgaccgattcagcggcagcggtctgagacagatttcactctcacntcngcacgcctgcagctagaacgatgtggctagtttatacgttgtcgagctagtattatagtacgtacctagtagtcgtttcgggaccgggtacgaacgtcgtaggacgagtacgaaacggtaacgtagtacggcgttagaccactacgtcgttacgtcttctactcccg

SEQ ID NO: 4079 - DNA, 500 bp, Homo sapiens
  misc_feature: GYAE6OF02JCAV2.39.31.C09.1.454.CMB.1.raw
  modified_base (430)..(430): a, c, t, g, unknown or other
  misc_feature (430)..(430): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggtgacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctagagatgtgctagtttattactgtcagctagtattatagtagtcctnagtcgttttgggaccggggactaagcgtaggagatacgaaacgtactggtgctgcacatctgtcctctac

SEQ ID NO: 4080 - DNA, 508 bp, Homo sapiens
  misc_feature: GYAE6OF02GJGNQ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcggcggcagcgggtctgagacagatttcactctcaccatcagcagcctgcaggctgaagatgtggctagtttatactgtcagcagtattatagtagtcctcagtacgtttgggccggggtacaagcgtggagatacaaacgtacgtggtggctgcaccatctgtcttctactcctcccg

SEQ ID NO: 4081 - DNA, 515 bp, Homo sapiens
  misc_feature: GYAE6OF02HU67M.39.31.C09.1.454.CMB.1.raw
  modified_base (308)..(308): a, c, t, g, unknown or other
  misc_feature (308)..(308): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaacccaggacagcctcctaagtgctcatttactgggcatctacccgggngtccggggtccctgaccgattcagcggcagcggtctgagacagatttcactctcaccatcagcacgcctgcgaggctagaagatgtgctagtttatacttgtcagtcagtattatagtacgtcctctagtacgtttcgggccgggtacgaagcgtaggagtatacaaacgaactgtaggctcgcaccattctgtccttctacttccc

SEQ ID NO: 4082 - DNA, 501 bp, Homo sapiens
  misc_feature: GYAE6OF02HJVGN.39.31.C09.1.454.CMB.1.raw
  modified_base (463)..(463): a, c, t, g, unknown or other
  misc_feature (463)..(463): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagccctgcaggctgaagatgtggcagtttattaactgtcagcagtattatagtagtcctcagtacttttgggccggggtaacagcgtaggngatcaaacgactgtggctgcacatctgtcttcattccg

SEQ ID NO: 4083 - DNA, 512 bp, Homo sapiens
  misc_feature: GYAE6OF02HXN2W.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcagaaaccaggacagcctcctaagttgctcatttactgggcatcgtacccgggagtccggggtccctgaccgattcagcggcagcgggtctgagacagatttcactctcacatcagcagcctgcaggctagaagagtgtggctagtttattactgtcagctagtatagtagtagtcctcagtacgtttcgggccggggtacaagcgtaggagatacaaacgacgtagtggactagcacatctcgttcttcattcccg

SEQ ID NO: 4084 - DNA, 494 bp, Homo sapiens
  misc_feature: GYAE6OF02G0OCQ.39.31.C09.1.454.CMB.1.raw
  modified_base (491)..(491): a, c, t, g, unknown or other
  misc_feature (491)..(491): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgagatgtggctagttattactgtcagcagtattatagtacgtctcagtacgtttgggccgggaccagctggagatacaacgactgtggctgcaccatctgtcttctntcc

SEQ ID NO: 4085 - DNA, 509 bp, Homo sapiens
  misc_feature: GYAE6OF02I4EB2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttacacaggtccaacaataagaattacttcgcttgtaccagcagaaaccaggacagcctcctaagttgctcatttactggggcatctacccgggagtcccggggtcctgaccgattcagcggcagcgggtctgagacagatttcactctcaccatcagcagcctgcaggctgaagatgtggctagtttattactgtcagcagtattatagtagtcctctagtacgttttcgggccgggggtaccaaggctggagagtacaacgtaatgtggctgcaccgtatcgtgtcttcattcccg

SEQ ID NO: 4086 - DNA, 495 bp, Homo sapiens
  misc_feature: GYAE6OF02GS772.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcagcgggtctgagacagatttcactctcaccatcagcagcctgcaggctgaagatgtggcagtttatactgtcagcagtattatagttatcctcagtacttttgggccggggacaagctggagatcaaacgactgtggcgtgcacatctgtcttcattccg

SEQ ID NO: 4087 - DNA, 523 bp, Homo sapiens
  misc_feature: GYAE6OF02FTVEE.39.31.C09.1.454.CMB.1.raw
  modified_base (386)..(386): a, c, t, g, unknown or other
  misc_feature (386)..(386): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtcctgaccgattcagcggcagcgggtctgagacagatttcactctcaccatcagcagctgcaggctgaagntgtggctagtttattactgtcagcagtattatagttagtctacagtacgttttgggaccggggtaccaagcgtaggagtatacgaaacgtaacgtggtacggcgtacgacaccagttctcggtctttaccattcccg

SEQ ID NO: 4088 - DNA, 816 bp, Homo sapiens
  misc_feature: GYAE6OF02J3KFE.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgcctacgggacatcgtgatcgacccagtctccagacctcccgtggctgtgtctcgtgggcgagacggccacatcaactgacaacgtccagccaggtagttacgtttaacacgtacggtaaccaaacgtaattaacgtaacttaccgttcgtacgttacggaaccagaccaacgaaaccgaggaccacgtaccttacgtaagttcgtactacttacgtttacgacggtactaccgtacccggtaccgggtacggtcccggttccgtaaaaacggccgtacttaccgacgggccggacgtacgggtccggtacgtaggaacgtacgtacgttacctttaccgaccgttacctacccgtaacctacgttaccgaacggtaccgtaaccggtcccgttaaggacccggtaacggttaccgtaaagggtaaaaccgtttcgggtttacgggtacggttaaccttttaaagttttaccgttaccggttcgtaaccgtacggttaacttaagtttaactttaacggtaccgttaccgttacccgtaggttaacccgggttttaccgggttaacccgggggaccgggtaaaccttagggtaccgtaacgggtaactaccgtaacccggtaacggttcggtcggtacgtaccgtaccggtacctaccgttcgttaccgttccgttacccttacctcccgtttaaccccg

SEQ ID NO: 4089 - DNA, 501 bp, Homo sapiens
  misc_feature: GYAE6OF02HMAF5.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaaccaggacagcctcctaagttgctcatttactgggcatctacccgggagtccggggtcctgaccgattcagcggcagcggtctgagacagatttcactctcacatcagcagcctgcagctgaagatgtggcagtttatactgtcagcagtattatagtagtcctcagtactttcggaccggggaccaagcgtaggagatacgaaacgaactgtaggctcgacacatctcgtcttcattccg

SEQ ID NO: 4090 - DNA, 500 bp, Homo sapiens
  misc_feature: GYAE6OF02IYUM4.39.31.C09.1.454.CMB.1.raw
  modified_base (385)..(385): a, c, t, g, unknown or other
  misc_feature (385)..(385): n is a, c, g, or t
  modified_base (429)..(429): a, c, t, g, unknown or other
  misc_feature (429)..(429): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtcctgaccgattcagcggcagcggtctgagacagatttcactctcacatcagcagcctgcaggctgaagntgtggctagtttattactgtacagctagtattatagtagtcctntagtcgtttcgggccggggtacgagcgtaggagatacgaacgactgtggctgcacatctgtcttcacttcc

SEQ ID NO: 4091 - DNA, 631 bp, Homo sapiens
  misc_feature: GYAE6OF02JZQDI.39.31.C09.1.454.CMB.1.raw
  modified_base (291)..(291): a, c, t, g, unknown or other
  misc_feature (291)..(291): n is a, c, g, or t
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
tcagtcgcactagtcacgaccggtgctcgatttagacgtctcatcaaggaaggaagggcgagcaagatggtgttgcagacccaggtcttcatttctctgttgctctggatctctgtgcctacgggacatcgtgatgacccagtctccagactccctggctgtgtctctgggcagagggccaccatcaactgcaagtccagccagagtgttttacacaggtccaacaactaagaattactcgcttggtacctagcagaaaccaggacagcctacctaagttgctcatttacnggcatctaccgggatccgggtcctgaccgatcagcggcagcggtctgagacagntttcacgtctcacctancagcagcctgcagctgaagatgtcggatacggtttattacgtagttacagtacgtaacgttattaagttaacgttaacgttcccgttaacgtaggttaaccgttttttacggggaacccgggggttaacctaaacggtccgtttacgggaacggtacgttaaccggaaaaccggttaacggttaacggttcgggtaacccgttaggtaacccgtacccgttaacttcccggttaccgtttacccgtttaccgtaaccgttttcccccgg

SEQ ID NO: 4092 - DNA, 498 bp, Homo sapiens
  misc_feature: GYAE6OF02I5CIH.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattacttgtcagcagtattatagtagtctcagtactttggccggggacagctggagatacaaacgaactgtggctcgcacctatctgtcttcattcccg

SEQ ID NO: 4093 - DNA, 549 bp, Homo sapiens
  misc_feature: GYAE6OF02F6XI4.39.31.C09.1.454.CMB.1.raw
  modified_base (364)..(364): a, c, t, g, unknown or other
  misc_feature (364)..(364): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcattactggcatccgtacccgggagtccggggtccctgaccgattcagcggcaggcgggtctggagacagtatttcactcncaccatcagcagcctgcaggctagaagagtggtgactagtttattactcgtcagctaagttattagtagttacgtccttacgtagttacgttttcgggacccggggtaaccaggtcgtaggagtacgtacgaaacgtaacgtggtcggcgtcgccacgtacttccgtgttccttactacttcccg

SEQ ID NO: 4094 - DNA, 518 bp, Homo sapiens
  misc_feature: GYAE6OF02HVCIK.39.31.C09.1.454.CMB.1.raw
  modified_base (336)..(336): a, c, t, g, unknown or other
  misc_feature (336)..(336): n is a, c, g, or t
  modified_base (436)..(436): a, c, t, g, unknown or other
  misc_feature (436)..(436): n is a, c, g, or t
  modified_base (470)..(470): a, c, t, g, unknown or other
  misc_feature (470)..(470): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattactcgcttggtaccagcaagaaaccaggacagcctcctaagttgctcatttactgggcatcgtacccgggagtccgggtcctgaccgattcagcggnagcgggtctgagacagatttcactctcaccatcagcagcctgcaggctagaagatgtggactagtttattacgtgtcagctagtattatagtagtcctanagtacgtttcgggccggggtaacaagcgtagganacgtacaaacgtactgtgctagaccactatcgtgttacttcattcccg

SEQ ID NO: 4095 - DNA, 527 bp, Homo sapiens
  misc_feature: GYAE6OF02GSBUK.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacnggcatcgtacccgggagtccgggtcctgaccgattcagcggcagcggtctgagacagatttcactctcaccatcagcagcctgcaggctagaagagtgtgactagtttattactgtacagctagtattatagtacgtacctcgtacgtacgtttcggaccggggtaccaagcgtaggacgtactacgaaacgtaactgtcggtcgtcgacacgtctcgtgtcttactcgttcccg

SEQ ID NO: 4096 - DNA, 545 bp, Homo sapiens
  misc_feature: GYAE6OF02HE0TW.39.31.C09.1.454.CMB.1.raw
  modified_base (282)..(282): a, c, t, g, unknown or other
  misc_feature (282)..(282): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttnctcatttactgggcatcgtacccgggagtccggggtccctgaccgattcagcggcagcggtctgagacagatttcactctcaccatcagcagcctcgcaggctgaagatgtggactagtttattacgttgtacagtcagtatatttttttagagttacctactagtacgttttcgggaccggggtaccgaagacgtggacgagtacgtaaacgtaacgtacggtggtcgtacgcctaaccacgtcttcgtcttctacttcccg

SEQ ID NO: 4097 - DNA, 522 bp, Homo sapiens
  misc_feature: GYAE6OF02HEL8I.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattacttgtcagctagtattatagtagtcctctagtacgtttgggaccggggtaccaacgcgtggagactacgaaacgtaacgtagtggcgtcgacacctatctgttccttactattcccg

SEQ ID NO: 4098 - DNA, 512 bp, Homo sapiens
  misc_feature: GYAE6OF02F6TKY.39.31.C09.1.454.CMB.1.raw
  modified_base (290)..(290): a, c, t, g, unknown or other
  misc_feature (290)..(290): n is a, c, g, or t
  modified_base (345)..(345): a, c, t, g, unknown or other
  misc_feature (345)..(345): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctctaagttgctcatttacnggcatcgtacccgggagtccggggtcctgaccgattcagcggcagcgggtctganacagatttcactctcaccatcagcacgctgcaggctagaagatgtggctagtttattactgtcagcagttattatagtacgtcctacagtacgtttgggaccggggtaaccaggcgtgggagatacgaaacgtactgtggctgaccaccatcctgtcttcattcccg

SEQ ID NO: 4099 - DNA, 651 bp, Homo sapiens
  misc_feature: GYAE6OF02JZETR.39.31.C09.1.454.CMB.1.raw
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctggcgagaggccaccatcaactgcaagtccagccagagtgttttacacaggtccaacaataagaattacttcgcttggaccagcagaaaccaggacagcctactaatgctcatttacgnggnaactcgtacccgggngtacccggggttcctggacccgtaattcgtaacggccggaccacggtccgggtactcggaagaccgaaggtactttccgaactcgtccaacccgtaattccgacgacgtacgcctcgacacggtactacggaagtaagtcgttcgggtactaacgtttacttacgttacgttacacggtctaaagttattacgttagttaacgtccgtactaacgtcgttttacgggaccgggtaaccgtacggaccgttaggtaggtacgtaaccgtaaacggtaacgttaggttcggaacgttcgtaaccgtacccgtagtccgttacggtttaaccttcctaacggtttcccc

SEQ ID NO: 4100 - DNA, 521 bp, Homo sapiens
  misc_feature: GYAE6OF02JQ9N8.39.31.C09.1.454.CMB.1.raw
  modified_base (207)..(207): a, c, t, g, unknown or other
  misc_feature (207)..(207): n is a, c, g, or t
  modified_base (377)..(377): a, c, t, g, unknown or other
  misc_feature (377)..(377): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcagtccagccagngtgttttacacaggtccaacaataagattacttcgcttgggtaccagcagaaacccaggacaatcctcctaagttgctcatttactggcatctacccggagtccggggtcctgaccgattcagcggcagcgggtctgagacagtatttcactctcaccatcagcagcctncaggctgagatgtgcagtttatttactgtcagctagtattattaagttagtcctcagtacgttttcgggtccggggggaccaaggcgtgggagatacaaacggtaaacgtggtacggcgtgcaccactctgtccttctattccc

SEQ ID NO: 4101 - DNA, 546 bp, Homo sapiens
  misc_feature: GYAE6OF02JHL75.39.31.C09.1.454.CMB.1.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (424)..(424): a, c, t, g, unknown or other
  misc_feature (424)..(424): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttaacacaggtccaacaataagaattacttcgcttggtaccagcagaaaccaggacagcctcctaagttnctcatttacngggcatcctacccgggagtcccggggtccctgaccgattccgagtccggcaggtcggtctgacgacagtatttcactctacaaccatcagcagcctgcagctagagatgtggactagttattactgtacgancagttatatagtacgtactactagtacgtttcggaccgggtacgtaacgacgtagagactacgtaaacgtaactacggtaggtacgtagacgactacgtccgtacgttctactacttacccg

SEQ ID NO: 4102 - DNA, 518 bp, Homo sapiens
  misc_feature: GYAE6OF02I7GW8.39.31.C09.1.454.CMB.1.raw
  modified_base (386)..(386): a, c, t, g, unknown or other
  misc_feature (386)..(386): n is a, c, g, or t
  modified_base (512)..(512): a, c, t, g, unknown or other
  misc_feature (512)..(512): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcgcagcggtctgagacagatttcactctcaccatcagcagcctgcaggctgaagntgtggctagttattactgtcagcagtattatagtacgtctctagtacgttttcgggaccggggtacaaggtcgtaggacgataccgaaacgtaacgtgtaggcttgcgacctagtctgtcttactnttcccg

SEQ ID NO: 4103 - DNA, 607 bp, Homo sapiens
  misc_feature: GYAE6OF02JTT62.39.31.C09.1.454.CMB.1.raw
  modified_base (409)..(409): a, c, t, g, unknown or other
  misc_feature (409)..(409): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgttttacacaggtccaacaataagaattaactcgcttggtaccagcagaaaccaggacagcctcctaagttgctcatttactgggcatctacccgggagtaccggggtccctgaccgattcaacgtcgcagcggtcctgagacagacgtttcaactcgtccaccacttacgagtcacgcctgccaaggcctaggaacgnttaggtggcctaaggtttactacgtgtacagtacagtaatattagtacgttacctcgagttacgttttcggggacccggggtaaccaaggtccgtaggtaacgtactacgtaaaaccggtaccgttaaggttcgggtactacggtacccgtaccctaacgttacccgttaggttaacctttacccagtttacccccgg

SEQ ID NO: 4104 - DNA, 495 bp, Homo sapiens
  misc_feature: GYAE6OF02GTWIW.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcagcggtctgagacagatttcactctcaccatcagcagcctgcaggctgaagatgtggctagtttattactgtcagcagtattatagtagtcctcagtacttttggaccggggtacaagctggagatacaacgaactgtggctgcacatctgtcttcatcc

SEQ ID NO: 4105 - DNA, 516 bp, Homo sapiens
  misc_feature: GYAE6OF02HSNFX.39.31.C09.1.454.CMB.1.raw
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcgtacccgggngtccggggtccctgaccgattcagcggcaggcggtctgagacagatttcactctacaccatcagcagcctgcaggctgaagagtgtggctagtttattactgtcagctagtattatagtagtcctactagtacgtttcgggaccggggtaaccagcgtggagagtacgaaacgtactggtggcgtcgcacatctgtcttcattcccg

SEQ ID NO: 4106 - DNA, 508 bp, Homo sapiens
  misc_feature: GYAE6OF02I3Z55.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccgggtcctgaccgattcagcggcagcgggtctgagacagatttcactctcaccatcagcagcctgcagctgaagatgtgcagtttatactgtcagcagtatatagtagtacctcagtacgtttggccggggtaaccaaggctggagactacgaaacgtaactggtggctgacctaccgatcgtgtccttacattcccg

SEQ ID NO: 4107 - DNA, 508 bp, Homo sapiens
  misc_feature: GYAE6OF02F38W0.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcacatcagcagcctgcaggctagaagatgtggctagtttattactgtcagcagtattatagtagtcctcagtacgtttgggccggggaccaagcgtggagatacaaacgtaactgtcggctcgcacctatcgtagtcttcgattcccg

SEQ ID NO: 4108 - DNA, 556 bp, Homo sapiens
  misc_feature: GYAE6OF02JGOZW.39.31.C09.1.454.CMB.1.raw
  modified_base (291)..(291): a, c, t, g, unknown or other
  misc_feature (291)..(291): n is a, c, g, or t
  modified_base (386)..(386): a, c, t, g, unknown or other
  misc_feature (386)..(386): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacnggcatctacccgggagtccgggtcctgaccgattcgagcgcagcgggtctgagacagtatttcactctcaccatcagcagcctgcaggctagagngtgtgactagtttatactgtcagctagttatagtagtacgtcctcgtagtacgtttacgggaccgggtactaacggtcgtagggagtacgtaacgaaaccggtaacttacggtcggtaccgttacgaccctaaccgtacttccgtcgtttaccttaccgtactttccccg

SEQ ID NO: 4109 - DNA, 504 bp, Homo sapiens
  misc_feature: GYAE6OF02FFP6I.39.31.C09.1.454.CMB.1.raw
  modified_base (290)..(290): a, c, t, g, unknown or other
  misc_feature (290)..(290): n is a, c, g, or t
  modified_base (386)..(386): a, c, t, g, unknown or other
  misc_feature (386)..(386): n is a, c, g, or t
  modified_base (488)..(488): a, c, t, g, unknown or other
  misc_feature (488)..(488): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagattacttcgcttggtaccagcagaaaccaggacagcctcctaagttgctcatttacngggcatctacccgggagtccggggtcctgaccgattcagcggcagcgggtctgagacagatttcactctcaccatcagcagcctgcaggctgaagntgtggcagtttattactgtcagcagtattatagtagtcctcagtacgttttgggccggggtacaaggcgtaggagtatacgaaacgtaactgtggctgcacntctgtcttcattcccg

SEQ ID NO: 4110 - DNA, 520 bp, Homo sapiens
  misc_feature: GYAE6OF02IM9IN.39.31.C09.1.454.CMB.1.raw
  modified_base (361)..(361): a, c, t, g, unknown or other
  misc_feature (361)..(361): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagcagatttcactcncaccatcagcagcctgcaggctgaagatgtggctagtttattactgtcagctagtattatagtagtcctctagtacgttttgggaccggggtaccgaagtcgtggagatacgaaacgaacgtgtggcttgacctaccacttcctgttcttctattcccg

SEQ ID NO: 4111 - DNA, 505 bp, Homo sapiens
  misc_feature: GYAE6OF02IHU12.39.31.C09.1.454.CMB.1.raw
  modified_base (434)..(434): a, c, t, g, unknown or other
  misc_feature (434)..(434): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcgtacccgggagtccggggtccctgaccgattcagcggcagcggtctgagacagatttcactctcaccatcagcagcctgcaggctagaagatgtggactagtttattactgtcagctagtattatagtagtcctnagtacgtttggccgggtacagcgtaggagatacgaacgaactagtggctgacacactctgtcttcatcccg

SEQ ID NO: 4112 - DNA, 513 bp, Homo sapiens
  misc_feature: GYAE6OF02IPBUE.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccggggagtccgggggtccctgaccgattcagcggcagcgggtctgagacagatttcactctcaccatcagcagcctgcaggctgaagatgtggcagtttattactgtcagcagtattatagtagtcctcagtacgttttgggaccggggtaccaaggctaggagatacgaaacgaacgtgtggctgacacctatctgtcttacattcccg

SEQ ID NO: 4113 - DNA, 578 bp, Homo sapiens
  misc_feature: GYAE6OF02HEWSI.39.31.C09.1.454.CMB.1.raw
  modified_base (389)..(389): a, c, t, g, unknown or other
  misc_feature (389)..(389): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttactgggcatctacccgggagtccggggtccctgaccgattcagcggcaggcggtctgagacagatttcactctcaccatcagcagcctgcaggctagaagntgtggactagtttattacgtgtacagtcaagttattaatagtacgttcctacgtagttacgttttacgggacccgggggtaaccaaggtccgtagggtaagtataaccgaaaacggtaacttgggttacggccgttacggacctaacccgtacgttcccttacggtttcctttaccgtatttacccccg

SEQ ID NO: 4114 - DNA, 512 bp, Homo sapiens
  misc_feature: GYAE6OF02GHIZ3.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacngggcatctacccgggagtccggggtccctgaccgattccagcggcagcgggtctgagacagatttcactctcaccatcagcagcctgcaggctagaagatgtggctagtttattactgtcagcagtattatagtagtcctacagtacgttttcgggccggggaccaagcgtaggagactacgaaacgaactgtggctcgcaccatcctgtcttcattcccg

SEQ ID NO: 4115 - DNA, 539 bp, Homo sapiens
  misc_feature: GYAE6OF02GEDCU.39.31.C09.1.454.CMB.1.raw
  modified_base (434)..(434): a, c, t, g, unknown or other
  misc_feature (434)..(434): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcaggcgggtctgagacagatttcactctcaaccatcagcagcctgcaggctgaagatgtggctagtttattactgtcagcagttattatagtagtcctntagtacgttttcgggcccggggtaaccaaaggtctagggagtacgtacgaaacgtaacgtgtcggcttacgaccaccgtacttccgtgttaccttacacttcccg

SEQ ID NO: 4116 - DNA, 550 bp, Homo sapiens
  misc_feature: GYAE6OF02IKC47.39.31.C09.1.454.CMB.1.raw
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatcctacccgggngtccggggtcctgaccgattcgagcggcagcggtcngagacagatttcactctcacatcagcagcctgcgacggctagaagagtgtggactagttttattgcttgtacgagtctagtattagtagttacgttccctagacggttacgttttcgggacccgggggtaaccaaggtcgtaggagtacgtacgaaaacgtacgtggtcggacgtacgacaaccgtattcgtgttaccttctaccg

SEQ ID NO: 4117 - DNA, 504 bp, Homo sapiens
  misc_feature: GYAE6OF02G3NMK.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcagctgaagatgtgctagtttattactgtcagcagtattatagtacgtcctctagtacgttttgggccggggtaccaagctggacgatacaacgtaactgtcggctgcaccatctgtcttcattccc

SEQ ID NO: 4118 - DNA, 506 bp, Homo sapiens
  misc_feature: GYAE6OF02HGVTB.39.31.C09.1.454.CMB.1.raw
  modified_base (428)..(428): a, c, t, g, unknown or other
  misc_feature (428)..(428): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtggctagtttatactgtcagcagtattatagtagtcctnagtacttttgggaccggggtaccaagcgtggagatacaaacgaactgtacggctgacactagtctgtcttcattcccg

SEQ ID NO: 4119 - DNA, 588 bp, Homo sapiens
  misc_feature: GYAE6OF02IOV39.39.31.C09.1.454.CMB.1.raw
  modified_base (289)..(289): a, c, t, g, unknown or other
  misc_feature (289)..(289): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctctaagttgctcatttacngggctagtcctacccgggagtccggggtccctgaccgattcagcggcaggcgggtctgagacagatttcactctcacatcagcagcctgcaggctgaagagtgtgctagtttattacgtgtcagctagttattagttagttacgtcctcgtacgtaacgttttcggggacccggggtaaccgtaacggtacgttacgggagtacgtaaccgtaaaaccggtaacgttacggtacgggtaccttcggtacccgtaaccgtacgttaccgttacggttacctttaccgtactttacccccg

SEQ ID NO: 4120 - DNA, 571 bp, Homo sapiens
  misc_feature: GYAE6OF02IH8MB.39.31.C09.1.454.CMB.1.raw
  modified_base (329)..(329): a, c, t, g, unknown or other
  misc_feature (329)..(329): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttttacacaggtccaaacaataagaattacttacgcttaggtaccagacaagaaaccaggacagccctactaagttgctacatttacgtggcatcctacccgggcgtccgggtccngacccgattcgagcggcaggcgggtctgaagacagtatttcacttctcaacctatccaagccagcctgcaggcgtagaacgtagtggtgcgtagtttatacgttgtacagacgtagtattagttagtacgttacgtcgagttacgtttcgggaccgggggtaacccaaggtccgtagggacgtacgtacgaacgtaacgtggtacgcgttcgacgtaccactcgtacgtacttcgacttccg

SEQ ID NO: 4121 - DNA, 515 bp, Homo sapiens
  misc_feature: GYAE6OF02F4JA2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcgtacccggagtccggggtcctgaccgattcagcggcagcgggtctgagacagatttcactctcaccatcagcagcctgcaggctgaagatgtggctagtttattactgtcagctagtattatagttacgtcctcagtacgttttgggaccggggtaaccagtcgtggagatacgaaacgtaacgtgtacggctgacacgatctgtcttcattcccg

SEQ ID NO: 4122 - DNA, 572 bp, Homo sapiens
  misc_feature: GYAE6OF02JDBNK.39.31.C09.1.454.CMB.1.raw
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctacctaagttnctcatttacgnggcatctacccgggagtccgggcctgaccgnttcagcggcagcggtctgagacagatttcactctacaccatccaagctagcctgcagctagaagatgtggatagtttactactgtacagtctagtattatacgttacgtaccttacgaacgttaccgttttacgggacccgggggtaactaaaggtccgtagggtaacgtacgtaacgaaaccggtaacgttacggttagggtctacgacacccgtagtccttacggtactttaccgtacttacccg

SEQ ID NO: 4123 - DNA, 545 bp, Homo sapiens
  misc_feature: GYAE6OF02JTQNT.39.31.C09.1.454.CMB.1.raw
  modified_base (289)..(289): a, c, t, g, unknown or other
  misc_feature (289)..(289): n is a, c, g, or t
  modified_base (383)..(383): a, c, t, g, unknown or other
  misc_feature (383)..(383): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctctaagttgctcatttacngggcatccgtacccgggagtccgggtcctgaccgattcagcgcagcggtctgagacagattcactctacacatcagcagcctgcagctgaagtntgtgctagtttatacgtgtacagtactagttacttagtacgtacgttcctagtacgtacgttttcgggacccggggtaactaagcgtaggagtactaacgaacggtaacgttggtggtacctggacctaacgtacttccgtgttaccttcgtacttaccccg

SEQ ID NO: 4124 - DNA, 531 bp, Homo sapiens
  misc_feature: GYAE6OF02GR9O5.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgactcatttactgggcatctacccgggagtccggggtcctgaccgtattcgagcggcagcgggtctgagacagtatttcactctcacctatcagcagcctgcaggctgaagagtgtggactagtttattacgtgtcagcagtattatagtagtacctctagtactttgggaccggggtaccagcgtaggagtatacgaaacgtaacgtcggtaggtctacgccacgtactcgtcgttacttcacttcccg

SEQ ID NO: 4125 - DNA, 555 bp, Homo sapiens
  misc_feature: GYAE6OF02IY6SL.39.31.C09.1.454.CMB.1.raw
  modified_base (348)..(348): a, c, t, g, unknown or other
  misc_feature (348)..(348): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattactcgcttggtaccagcaagaaccaggacagcctacctaagttgctcatttactgggcatcgtacccggagtccgggtcctgaccgattcagcgcagcggtctgagacngtatttcactctcactatcagccagcctgcgagcnggaanagtgtggactagtttattacgttgtacgagacgtagtactaagtagttaacgtctcgtaagtacgttttacgggaccgggtaaccgaacgcgttacggagtagtaacgtaacgtaacgtagtaggtacgtacgacgacctacgtacctcttacgtactacttacccg

SEQ ID NO: 4126 - DNA, 607 bp, Homo sapiens
  misc_feature: GYAE6OF02G6F12.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatccgtacccgggagtcccggggtcctgaccgattcagcggcaggcgggtctgagacagtatttcactctcaccatcagcagcctgcaggctagaagatgtggtactagtttattactgtacagtctaagttattagttagttacgttcccttagtacgttaccggtttttacggggacccggggggtaacctaacggtcgtagggaacgtacgttaaccgaaaaccggtaacgttacggttacgggtccgttaggacccgtaacccgtacgttcccgttacggtttacctttaccgtaccgtttcccccg

SEQ ID NO: 4127 - DNA, 505 bp, Homo sapiens
  misc_feature: GYAE6OF02FPHKR.39.31.C09.1.454.CMB.1.raw
tcagtcgcactagtcacgaccggtgctcgatttagacgtctcatcaaggaaggaaggggcagcaagatggtgttgcagacccaggtcttcatttctctcttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagttattacttgtcagcagtattatagtagtcctcagtacgttttgggccggggtacaagcgtgagatacaaacgaactagtggctgacacatcctgtcttacattcccg

SEQ ID NO: 4128 - DNA, 530 bp, Homo sapiens
  misc_feature: GYAE6OF02IM4PC.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagttattatagttagtcctcagttacgttttcgggacccgggggtaaccaaggcgtagggagacgtacgaaaacggtaactaggtggctgacacctatccgttgtcttcctattcccg

SEQ ID NO: 4129 - DNA, 594 bp, Homo sapiens
  misc_feature: GYAE6OF02I063M.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattactcgcttggtaccagcagaaaccaggacagcctactaagttgctacattactggctatcctaccgggtagtccgggtcctggaccgattcagcggacaggcggtctgacgacagatttcactcgtcaccatcagtactagcctagcaggctaggaagagtgtaggactacgtttattaccgtgtacaagtctaagttataattagtaacgttacctacgtaacgttaccggttttcgggacccgggtaaccgaaaggtccgtagggaatacgtaaccgaaacggtaacgttacggtacggtcctaggaccaacccgttacgttacctcggtttacccttacgtaacgttccccg

SEQ ID NO: 4130 - DNA, 588 bp, Homo sapiens
  misc_feature: GYAE6OF02FSCMX.39.31.C09.1.454.CMB.1.raw
  modified_base (307)..(307): a, c, t, g, unknown or other
  misc_feature (307)..(307): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggngtccggggtcctgaccgattcagcggcagcgggtctgagacagatttcactctcaccatcagcagcctgcaggctagaacgatgtgactagtttattacgttgtacagcgtaagttatttaatagttacgtccttactaaggttaccgttttacgggacccgggggtaaccgaaaggtccgttagggaacgtagtaacgtaaaaccggtaacgttaggtacgggtacgttacggaccgtaccgtacgttaccgttacgtttcttaccgtaactttcccccg

SEQ ID NO: 4131 - DNA, 578 bp, Homo sapiens
  misc_feature: GYAE6OF02FHZTD.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacgatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccggagtccggggtcctgaccgattcagcggcagcgggtctgagacagtattcactctcaccatcagcagcctgcgaggctacggaagagtgtagggctaggtttattacgtgtcgacgtcagttattagttagtacgttcctacgtacgtacgttttcgggaccgggggtaaccaaggtccgtagggtaagtacgtacgaaacggtaacgttaggtacggtacgtcggacctaaccgtacgttccgtttacggtcctttacgtacctttaccccg

SEQ ID NO: 4132 - DNA, 710 bp, Homo sapiens
  misc_feature: GYAE6OF02ISBM6.39.31.C09.1.454.CMB.1.raw
  modified_base (209)..(209): a, c, t, g, unknown or other
  misc_feature (209)..(209): n is a, c, g, or t
  modified_base (320)..(320): a, c, t, g, unknown or other
  misc_feature (320)..(320): n is a, c, g, or t
tcagtcgcactagtcacgaccggtgctcgatttagacgtctcatcaaggaaggaagggcgagcaagatggtgttgcagacccaggtcttcatttctctgttgctctggatctctggtgcctacgggacatcgtgatgacccagtctccagactccctggctgtgtctctgggcgagagggccaccatcaactgacaagtccagccaagngttagtttacacgaggtaccaacaataagtaattacgtctcgtttcggaacctagacaacgaaaccgaggaacaacggccttaccttaaagtgacctactacttttaacgngggacctactacccggtaaccgggtacggttccccggggttcccgtacgtaaccggtacttaccgaacggcgggtaaccagggtcccggttacgcggtaacgacgtaggttactttccgaccttctaccgtaacctattacgacggtcaacgtccgtcgacgacggtctaggaacgtatcggtacgacgtacgttttaactcgttagttacgagtacctaagttacttaagttacgtacttccgacgttacgttacggttttacggggacccggggtaaccgtaaacggtccgtaggtaacgtactaacggtaaaccgtcgttacggagtccggtacgtaccgtaaccgtacgttccgttacgttaccgtttacgtaccgtttaccccgg

SEQ ID NO: 4133 - DNA, 579 bp, Homo sapiens
  misc_feature: GYAE6OF02JK6XJ.39.31.C09.1.454.CMB.1.raw
  modified_base (206)..(206): a, c, t, g, unknown or other
  misc_feature (206)..(206): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
tcagtcgcactagtcacgaccggtgctcgatttagacgtctcatcaaggaaggaagggcgagcaagatggtgttgcagacccaggtcttcatttctctgttgctctggatctctgtgctacgggacatcgtgatgacccagtctccagactcccctggcctgtgtctctggcgagagggccaccagtcaactgcaagtccagccanagtgttttacacaggtccaacaataagaattactacgcttggtacctagcagaaaccaggaaccagcctctaagttgactcattactgggcatcctacccgggatccgggtccctcgaccgattccngcggcagcggtcngagacngatttcgactcgtcaccatccagcagccngcaggctganagtgtgcgtagttacttactagtcctgacctaggtaattagtacgttaacgtccttactacgttacctttttgggacccgggggtaaccctaggtaccgtgtaacggtataccgaaaccggtaactacggttacggtacgttccgaccgtacctacgtccgttacgtacctttactaacctttccccg

SEQ ID NO: 4134 - DNA, 522 bp, Homo sapiens
  misc_feature: GYAE6OF02G5SK5.39.31.C09.1.454.CMB.1.raw
  modified_base (327)..(327): a, c, t, g, unknown or other
  misc_feature (327)..(327): n is a, c, g, or t
  modified_base (395)..(395): a, c, t, g, unknown or other
  misc_feature (395)..(395): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcctacccgggagtccggggtcctgaccgnttcagcggcagcgggtctgagacagatttcactctacaccatcagcacgcctgcaggctagaagatgnggctagtttattactgtcagctagtatatagtatcctgtagtcgtttcgggccggggtaacagtcgtaggacgatacgaaacgtacgtagtggtctcgacacctatccgttcgtcttctacgtcccg

SEQ ID NO: 4135 - DNA, 551 bp, Homo sapiens
  misc_feature: GYAE6OF02HOLQ9.39.31.C09.1.454.CMB.1.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttacngggcatctacccgggagtccggggtccctgaccgattcagcggcagcgggtctgagacagatttcactctcaccatcagcagcctgcaggctgaagatgtggctagtttattactgtcagtcaagttattaagttagtacgttcctacgtagtacgttttcgggacccggggtaacctaaggcgtagggagtacgtaccgaaacggtaacgttggtacggtacgtgaccgtaccagtccttagttcttactacttaccccg

SEQ ID NO: 4136 - DNA, 536 bp, Homo sapiens
  misc_feature: GYAE6OF02GXQMW.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagagtgtggctagtttattactgtcagcagtattatagtagtcctacgtagtacgttttcgggacccggggtaccaaggtcgtagggagacgtacgaaacggtacgtagttcggcttcgaccacctattccgtgtactttctacttcccg

SEQ ID NO: 4137 - DNA, 527 bp, Homo sapiens
  misc_feature: GYAE6OF02G0IIN.39.31.C09.1.454.CMB.1.raw
  modified_base (327)..(327): a, c, t, g, unknown or other
  misc_feature (327)..(327): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcaagaaaccaggacagcctctaagttgctcatttactggcatctacccgggagtccgggtccctgaccgtnttcagcggcagcggtctgagacagtactttcactctacaccatcagcagcctgcaggctagaagatgtgctagtttattactgtcagctagtatatagtacgtctacgtagtacgtttcgggaccggggtacagtcgtagagtatacgaacgtaactgtacggcgtacgactaccacttcgtacgtcttacctattcccg

SEQ ID NO: 4138 - DNA, 574 bp, Homo sapiens
  misc_feature: GYAE6OF02GKVWF.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacaaaggtccaacaataagaattacttcgcttggtaccagcaagaaaccaggacagcctcctaagttgctcatttactgggcatctacccgggagtccgggtcctgaccgattcagcggcagcgggtctgagacagatttcactctcaccatcagcagccctgcaggctagaagagtgtcggactagtttaacttacttggtacagtctagttatttagtagttacgtcctactagtacgttttcggggaccggggtaccaaggtcgtagggagtacgttacgaaacggtacgtggtacggtactcgacctaaccgacgttccgttacgttcctttacctacgtttcccgttacccccgg

SEQ ID NO: 4139 - DNA, 604 bp, Homo sapiens
  misc_feature: GYAE6OF02I1OZ8.39.31.C09.1.454.CMB.1.raw
  modified_base (295)..(295): a, c, t, g, unknown or other
  misc_feature (295)..(295): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcagaaaccaggacagcctcctaagttgctctatttacgngggcatccgtacccggggagtcccggggtccctgaccgattcagcggcaggcggtctgagacagtatttcactctcacatacagcagcctgcgaggctagaagagtggtggtacgtagttttattacttcgtacagtactaagttaatttagtagttacgttacctacgtaacggttacggttttcggggacccgggggtaaacctaacggtacgtagggtagtacgtaaccgtaaaacggtaaccgttaggttacggtaccgtacgaccgtaccgtacttccgttacgttcctttaccgtacttcccg

SEQ ID NO: 4140 - DNA, 521 bp, Homo sapiens
  misc_feature: GYAE6OF02I0M1R.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcagtctacccggggatccggggtccctgaccgattcagcggcagcggtctgagacagatttcactctcaccatcagcagcctgcagctagaagatgtgctagttattactgtcagactagtattatagtagtctcgtagtacgttttgggccggggtaacgaacgtcgtaggagagtacgaaacgaacgtagtggtcgtgacactactcgtgtcttactattcccg

SEQ ID NO: 4141 - DNA, 678 bp, Homo sapiens
  misc_feature: GYAE6OF02JV7WS.39.31.C09.1.454.CMB.1.raw
  modified_base (69)..(69): a, c, t, g, unknown or other
  misc_feature (69)..(69): n is a, c, g, or t
  modified_base (246)..(246): a, c, t, g, unknown or other
  misc_feature (246)..(246): n is a, c, g, or t
  modified_base (302)..(302): a, c, t, g, unknown or other
  misc_feature (302)..(302): n is a, c, g, or t
tcagtcgcactagtcacgaccggtgctcgatttagacgtctcatcaaggaaggaaggggcgagcaaganggtgttgcagacccaggtcttcatttctctgttgctctggatctctggtgcctacgggacatcgtgatgacccagtctccagacctccctggctgtgtctctgggcgagagggccaccatcaactgacaagtccagccagagtgttttacacaggtaccaacaataagaattactcncttgtaccagacacaaacaggtacaacgcctacctaagttcgtactctactttacngggtacctagtaccgtaaccccggggtacggtaccccggggtccctcggaacccgtattaccgtagaccggggtccaggtccggggtctggacgaacgacgtacgtttacacccttcgtacctaccattaccacggtcaccgccgtagtaccgacggtcgtacggaacgagttaggtacggtcgtaacgttttagttacgttcgttacgagtacgtagtacttagtaacgttacgtaccttacgtacgttacgtttacgggaccggggtacgtaacggtcgtagggtacgtacgtaccgaacgtaaccgttggttacggtcgttacggaccgtaaccgtacgtaccgttacggttacctttacgtaccgttacccg

SEQ ID NO: 4142 - DNA, 513 bp, Homo sapiens
  misc_feature: GYAE6OF02FJTAK.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtccctgaccgattcagcggcagcgggtctgagacagatttcactctcaccatcagcagcctgcaggctgaagatgtggctagtttattactgtcagcagtattatagtagtctcagtacgttttgggccggggtaccaagctggagatacaaacgaactgtacggtctacgcaccgattccgtgtccttcattccccg

SEQ ID NO: 4143 - DNA, 760 bp, Homo sapiens
  misc_feature: GYAE6OF02IYQ2R.39.31.C09.1.454.CMB.1.raw
  modified_base (359)..(359): a, c, t, g, unknown or other
  misc_feature (359)..(359): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacgggacatcgtgatgacccagtctccagactccctggctgtgtctctgggcgagagggccaccgatcaactgcaagtccagccagagtgttttacacaggtccaacaataagaattactcgtacttgtaccagacaagaaaccaggacagcctacctaagttcgtctactatttacgtgggactactccgtacccgggagttcccggggtacccctgaccgtactctaggccgganacggtacggggtctagtacgacagtacgtttacacttcgtaccaacctacgtccaaaggccaagtccctacggccgacggaccttaggaagtacgtagggtacggtacgtaacggtttttacttaaccgttggttaccgtaacgaccgttaagttaacgtttaaacgttacgggttaacggttaccctttaccggtaacggttttaccggtttttaccggggggtaaccccgggggggtaaacctaaacgggttacccggttaggggtaaccgtacggttaaaccgtaaaacccgggttaaccggttaaaggttccgggtaaccgttaaccggtacccggttaacccgttaacgttacccgtttacggtttaccctttaccgtaccgtttttaccccccgg

SEQ ID NO: 4144 - DNA, 523 bp, Homo sapiens
  misc_feature: GYAE6OF02G56DH.39.31.C09.1.454.CMB.1.raw
  modified_base (517)..(517): a, c, t, g, unknown or other
  misc_feature (517)..(517): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatcgtacccgggagtccggggtccctgaccgattcagcggcagcggtctgagacagatttcactctcacatcagcagcctgcaggctgaagagtgtgctagtttattacgtgtcagactagttatatagtacgttcctgtagtacgtttcgggaccgggtaccgaggtcgtaggagacgtacgaaacgtaacgtggtcgctgactactatcgtactcttctnttcccg

SEQ ID NO: 4145 - DNA, 538 bp, Homo sapiens
  misc_feature: GYAE6OF02HIQ79.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaaactgcaagtccagccagagtgttttacacaggtccaaacaataagaattacttcgcttggtaccagcaagaaaccaggacagcctcctaagtgctcatttacngggcatctacccggagtccggggtcctgaccgattcagcggcagcggtctgagacagatttcactctcaccatcagcagctgcagctagaagagtgtggctagtttaagttacttgtacagactagtattatagtagtacctcacgtacgtttaggaccgggggtaacaacgcgtaggagactacgaaacgtaacgtagtggactacgactaccgtacttccgtagtccttacgtacttacccg

SEQ ID NO: 4146 - DNA, 549 bp, Homo sapiens
  misc_feature: GYAE6OF02HUZFG.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaaagttgctcatttacngggcatctacccgggagtcccggggtcctgaccgattcgagcggcaggcgggtctgagacagatttcactctcaccatcagcacgcctgcacggctagaagatgtggctaagtttattatgtcagactagttattatagttacgtctacgtagtacgttttcgggaccggggtaccgaaggtcgtagggacgtactacgaaacggtaacgtggtaggtcgtcgcgtaccacgtccgttgtcttacgtacttcccg

SEQ ID NO: 4147 - DNA, 528 bp, Homo sapiens
  misc_feature: GYAE6OF02HJJDB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccgggagtccggggtccctgaccgattcagcgcagcgggtctgagacagatttcactctcaccatcagcagcctgcaggctaggaagatggtggcgtagttttacttacgttgtcacgtctagtattaatagtagttcctcgtagttacgttttgggccggggtaaccaaggcgtaggagatacgaacgacgtagtggctagctaccatccgtgtccttcattcccg

SEQ ID NO: 4148 - DNA, 581 bp, Homo sapiens
  misc_feature: GYAE6OF02IGDDK.39.31.C09.1.454.CMB.1.raw
  modified_base (388)..(388): a, c, t, g, unknown or other
  misc_feature (388)..(388): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctggcgagaggccaccatcaactgcaagtccagccagagtgttttacacaggtaccaacaataagaattacttcgcttggtaccagcaagaaaccaggacagcctctaagtgctcattactgggcatccgtacccgggagtccgggtcctgaccattcagcggcagcggtctgagacagatttcactctcaccatcagcagcctgcaggctagaagatgngctagtttattactgtacacgactagttaacttagtacgtacgtccttacgtagttacgttttcggggacccgggggtaaccaaaggccgttagggaacgtagtacccgtaaaacggtaaaccgttcgggtacggtccgttacggacctaaccgtacgttccgttacggttacctttcccgagtttacccccg

SEQ ID NO: 4149 - DNA, 537 bp, Homo sapiens
  misc_feature: GYAE6OF02JZO8I.39.31.C09.1.454.CMB.1.raw
  modified_base (292)..(292): a, c, t, g, unknown or other
  misc_feature (292)..(292): n is a, c, g, or t
  modified_base (396)..(396): a, c, t, g, unknown or other
  misc_feature (396)..(396): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcctacccggagtccggggtcctgaccgattcagcggcagcgggtctgagacagtatttcactctcaccatcagcagcctgcaggctagaagatgtggntagtttactacgtgtcaggctagtattagtagtaagttcctacagttacgttttcgggaccggggtaacctaaggcgtagagtactacgtaaacgaactggtacggcttacgactaccgtctacttcgtacttcattcccg

SEQ ID NO: 4150 - DNA, 508 bp, Homo sapiens
  misc_feature: GYAE6OF02GNMM1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgcccatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtacgttttggccgggggtaccaaggctggagatacaacgacgtgtaggctgcacatctgtcttcactcttccccg

SEQ ID NO: 4151 - DNA, 545 bp, Homo sapiens
  misc_feature: GYAE6OF02HHGES.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagaattactcgcttggtaccagcaagaaaccaggacagcctctaagtgctcatttacnggcatcgtacccgggagtcccgggtcctgaccgattcgagcggcaggcggtctgagacagtatttcactctcacatcagcacgcctgcacggctagaagtagtgtggtactagttttactacgtgtcagactagtatagtagtacgtctacgagttacgtttcgggccgggtaacctagcgtaggaagtactacgaacgtaactggtacgtacgtacgaccgtacctactccgttcgtccttacgattccccg

SEQ ID NO: 4152 - DNA, 532 bp, Homo sapiens
  misc_feature: GYAE6OF02JX4KK.39.31.C09.1.454.CMB.1.raw
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctctatttactgggcatcctacccgggagtccggggtcctgaccgtattcagcggcaggcggtctgagacngtatttcactcncacatcagcagctgcagctagaagatgtggcctagtttactacgtcgtcagactagtattaatagtacgtcctcgtagttacgtttcgggccgggtaacacgcgtgatactacgaacgtctaggtgtcgtacgtaccaccgtattcctgttccttactacttacccg

SEQ ID NO: 4153 - DNA, 689 bp, Homo sapiens
  misc_feature: GYAE6OF02H1Z1D.39.31.C09.1.454.CMB.1.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtcctccagactccctggctgtgtctctgggcgagagggccaccatcaactgcaagtccagccagagtgttttacacaggtccaaacaataaagaattacttcgcttggtaccagacaagaaaaccaggacagcctctaagttgctntattacgtggacataccgtaacccgggtacgtcccgggtccctggaccgtagttcacggccggacgacggtcggggtcctggtacgacgtagtactttccacttcctacaaccataccgagcctacgaccgttcgacgtacggtaccgtagaaaggtaagttggtacggtacgtaagtttttaacgttacgttcgttacgacgtacgtaagttaagtttaattacggttaacgttaccttacgaacgttaccggttttacggggacccgggggtaacctaaaggtacgttagggtaacgtacgtaaaccggtaaaccggtaacgttacggttacggtaccgttacggtacccgtaaccgtaacgttccgttacggtttccttaccgtacgtttaccccg

SEQ ID NO: 4154 - DNA, 523 bp, Homo sapiens
  misc_feature: GYAE6OF02HDDPX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgctcatttactgggcatcctacccgggagtcccggggtccctgaccgattcagcggcagcgggtctgagacagatttcactctcaccatcagcagcctgcaggctagaagtatgtggctagtttattactgtcagctagtattatagtagtcctcagtacgtttcgggccggggtacgaagcgtagagatacgaaacgtaacgtggtaggctcgacacctatctcgtcttacgtcttcccg

SEQ ID NO: 4155 - DNA, 536 bp, Homo sapiens
  misc_feature: GYAE6OF02JHY3J.39.31.C09.1.454.CMB.1.raw
  modified_base (450)..(450): a, c, t, g, unknown or other
  misc_feature (450)..(450): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatccgtacccgggagtcccggggtccctgaccgtattcagcggcaggcgggtctagagacagtactttcactctacaccatcagcacgcctgcacggctagaagatgtggactagtttattacgtgtacagtctagttattagtagtacgtcctntagtacgtttcgggaccggggtaccagacgtaggagactacgaacggtactggtagacgtgactactactctgtctctacttcccg

SEQ ID NO: 4156 - DNA, 544 bp, Homo sapiens
  misc_feature: GYAE6OF02GF9PN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcacgcggcagcggtctgagacagatttcactctcacatcagcagcctgcagctagaagatgtggctagtttattactgtcagcagttattaatagtactcctctacgtacgttttcgggccgggggtaacctaaggccgtggagacgtaaccgaaacgtaacgtggtacggtctcggaccaaccgtacttccttcgtccttacctacttaccccg

SEQ ID NO: 4157 - DNA, 513 bp, Homo sapiens
  misc_feature: GYAE6OF02HTO1J.39.31.C09.1.454.CMB.1.raw
  modified_base (340)..(340): a, c, t, g, unknown or other
  misc_feature (340)..(340): n is a, c, g, or t
  modified_base (413)..(413): a, c, t, g, unknown or other
  misc_feature (413)..(413): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaaataagaattacttcgcttggtaccagcagaaaaccaggacagcctcctaagttgctcatttactgggcatcgtacccgggagtccggggtccctgaccgattcagcggnaggcggtctgagacagatttcactctcaccatcagcagcctgcaggctgaagatgtgctagtttattactgtnagctagtattatagtagtcctcagtacgtttgggaccggggtaaccgaagcgtaggagacgtacaaacgaactagtggctgacacactctgtcttcatcc

SEQ ID NO: 4158 - DNA, 576 bp, Homo sapiens
  misc_feature: GYAE6OF02GHQ2K.39.31.C09.1.454.CMB.1.raw
  modified_base (396)..(396): a, c, t, g, unknown or other
  misc_feature (396)..(396): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcagaaaccaggacagcctcctaagttgctctatttactgggcatccgtacccgggagtccggggtcctgaccgattcagcgcgaggcggtctgagacagtactttcactctccaccatcagcacgctgcaggctagaagntgtgactagtttatactgtacagctaagttattagtagtacgttcctagtacgttacgttttcggggaccggggtaactaacggtcgtagggaatacgtaactaaacggtaacttagggtacggtaccgtacgaccctaacgtactttaccgtacgtttccgttactaccgtttaccccg

SEQ ID NO: 4159 - DNA, 533 bp, Homo sapiens
  misc_feature: GYAE6OF02FH6DJ.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatccgtacccgggagtccggggtccctgaccgattcagcggcagcgggtctgagacagtatttcactctcaccatcagcagcctgcaggctgaagatgtggctagtttattacttgtcagcagttattatagttagtcctactagtacgttttcgggaccggggtaccaaggcgtaggtagatacgaaacgtaacgtgtacggtctagaccacctactcctgtccttctacttcccg

SEQ ID NO: 4160 - DNA, 572 bp, Homo sapiens
  misc_feature: GYAE6OF02G382U.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacgngggcatccgtacccggggagtcccggggtccctgaccgattcagcggcaggcggtctgagacagatttcactctcaccatcagcagcctgcaggctagaagatggtggactagtttattacgtgtcagctagttattagtagttacgtcctactagttaccgtttcggggcccggggtaacctaaggtcgtagggacgagtaaccgaaaccggtacgtaggtcggtactcggacctaaccgtacgttcgttacggtttaccctttacgtactttccccg

SEQ ID NO: 4161 - DNA, 595 bp, Homo sapiens
  misc_feature: GYAE6OF02HZGLW.39.31.C09.1.454.CMB.1.raw
  modified_base (297)..(297): a, c, t, g, unknown or other
  misc_feature (297)..(297): n is a, c, g, or t
  modified_base (399)..(399): a, c, t, g, unknown or other
  misc_feature (399)..(399): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgtttacacaggtccaaacaaataagaattacttcgcttggtaccagcaagaaaccaggacagcctactaagttgctctatttacnggtactagtccgtacccgggtacggtcccggggtccctggacccgtattccgaggcggcgacggcgggtctggacgacgagtactttcactctcaccatccngtcacgtccctagcgaggctaggaacgtgtaggtggtacttagttttaattaccttgtacgagtacgtaagttaattagtagttacgtcctacgtagttaccgtttcgggacccggggtaaccagcgtaggacagtaaccgaaacgtacgtggtggctcgacctaccgtatccgttgttccttactcgtttccccg

SEQ ID NO: 4162 - DNA, 552 bp, Homo sapiens
  misc_feature: GYAE6OF02JO9LG.39.31.C09.1.454.CMB.1.raw
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagtgttttacacaggtccaacaataagaattactcgcttggtaccagcagaaaccaggacagcctcctaagttgctcattactgggcatcgtacccggngtccgggtccctagaccgattcgacgcggtcacgcgggtctgacgacagatttcactctacaccatcancacgtcngcaggctagaagntgtaggctagtttactacgtagtcagcgtagtattagtacgtagtcctatagtaccgtttgggaccggggaacaagtcgtaggtagataaccgaaagtaaccgtaggtacggtacctagaccgtaaccctagtcgttacgtacctttcgtacttcccg

SEQ ID NO: 4163 - DNA, 724 bp, Homo sapiens
  misc_feature: GYAE6OF02FEXLM.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctcgtggtcgccgtacggggacatcgtgatcgacccagtcctccagtacctcccgtggtctgtcgtctcgtgggcgagacggcccacatcaactgacaacgtccagccagtagttcgttacacgtacgtaccaataataagtacttaccgtcgtacgttaggaccagaccaagaaacccgtaggacctaccgtccttacgtaagttctccttactacgtttacggcggtacctaccggttacccgggtacccgggtccgggtcccgggttcctacggaccgtagtccgacggtcggtacgacgggtccggtactaggacgtactagtttaccttaccgaccttcaccgaactacgtacgacgtaccacgtccggtagtaccggaggttacgtaaaggtacgttcggtacgtttacgtaactttacgtttactcgtacgacgtacgttacgtaagtttacgtacgttacggttccgacgttacggttacggtttaccgggttacggggaacccgtaatagggtaccgtaacggaaccttacgaaacggtacggttaacggtcggaccgtactacgaccgtactttcggtccttacgtaccctacttcccgtacccg

SEQ ID NO: 4164 - DNA, 526 bp, Homo sapiens
  misc_feature: GYAE6OF02FOEFN.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtccctgaccgattcagcggcagcggtctgagacagatttcactctcaccatcagcagcctgcaggctgaagatgtggctagtttattacttgtcagcagtatttagtagtacgtcctcagttacgttttgggacccggggtaacaggtcgtaggagtactacgaaacgtaacgtggtcgggactgacaccattctgttcttcacttcccg

SEQ ID NO: 4165 - DNA, 534 bp, Homo sapiens
  misc_feature: GYAE6OF02IXB9G.39.31.C09.1.454.CMB.1.raw
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaacaataagaattactcgcttggtaccagcagaaaccaggacagcctctaagttgctcatttactggcacgtctacccgggagtcccggggtccctaggaccgattcgacggcggacaggcggtctgagacagatttcgactctacacatcagcagctgcagctgagntgngactagtttatcgtgtcagtcagttatagtagtagtcctactagtacgtttcgggaccgggtaccaagtcgtaggagatacgaacgtaacgtgtacggacttcgacctacgtactcttaccgtcttcgatttccccg

SEQ ID NO: 4166 - DNA, 520 bp, Homo sapiens
  misc_feature: GYAE6OF02HBVJQ.39.31.C09.1.454.CMB.1.raw
  modified_base (292)..(292): a, c, t, g, unknown or other
  misc_feature (292)..(292): n is a, c, g, or t
  modified_base (434)..(434): a, c, t, g, unknown or other
  misc_feature (434)..(434): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtccctgaccgattcagcggcagcggtctgagacagatttcactctcaccatcagcagcctgcaggctagaagatgtggctagtttattacgtgtcagctagtattatagtacgtcctntagtacgttttcgggccggggtaccaagcgtaggagatacgaaacgtactaggtcggctcgacactactcctgtcttcacttcccg

SEQ ID NO: 4167 - DNA, 502 bp, Homo sapiens
  misc_feature: GYAE6OF02HOCS4.39.31.C09.1.454.CMB.1.raw
  modified_base (291)..(291): a, c, t, g, unknown or other
  misc_feature (291)..(291): n is a, c, g, or t
  modified_base (433)..(433): a, c, t, g, unknown or other
  misc_feature (433)..(433): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttacngggcatccgtacccgggagtccggggtccctgaccgattcagcggcagcgggtctgagacagatttcactctcaccatcagcagcctgcaggctgaagatgtggctagtttatactgtcagcagtattagtagtacgtcctnagtacgtttcgggccgggacagcgtgagagtacaacgactgtgctcgcactactctcgtcttcatcccg

SEQ ID NO: 4168 - DNA, 524 bp, Homo sapiens
  misc_feature: GYAE6OF02F0NUG.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcgtacccgggagtccggggtccctgaccgattcagcggcagcgggtctgagacagatttcactctcaccatcagcagcctgaagctgaagatgtggctagtttatactgtcagcagtattatagtatcctcagtacgttttcgggaccggggtaccaagcgtaggagatacgaaacgtacgtggtggctgaccaccgactcttcgttcttctacttccttaccccg

SEQ ID NO: 4169 - DNA, 528 bp, Homo sapiens
  misc_feature: GYAE6OF02I5G25.39.31.C09.1.454.CMB.1.raw
  modified_base (383)..(383): a, c, t, g, unknown or other
  misc_feature (383)..(383): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcaggcgggtctgagacagatttcactctcacatcagcagcctgcagcngaagatgtggctagtttattacgttgtacagcagttattagtagttagtcctcgagtacgtttcgggaccggggtaaccaggcgtggaagactacgaaacgtaactaggtggctcgacaccgattcctagttccttacattcccg

SEQ ID NO: 4170 - DNA, 543 bp, Homo sapiens
  misc_feature: GYAE6OF02IFO7X.39.31.C09.1.454.CMB.1.raw
  modified_base (294)..(294): a, c, t, g, unknown or other
  misc_feature (294)..(294): n is a, c, g, or t
  modified_base (418)..(418): a, c, t, g, unknown or other
  misc_feature (418)..(418): n is a, c, g, or t
  modified_base (439)..(439): a, c, t, g, unknown or other
  misc_feature (439)..(439): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaaacaataagaattacttcgcttaggtaccagcaagaaaccaggacagcctcctaagttgctctatttacngggacatcgtacccgggagtccgggtcctgaccgattcagcgcacggcgggtctgagacagactttcactctcaaccatcagtcacgtcctagcaggctagaagatgtgctagtttattatgtnagcagttatatagtacgtctnagtcgtttacgggaccggggtacaaagtcgtaggagacgtacgaacgtaacgtggtacggtacgtacgcctaccgacttacctggttacttcctacttaccccg

SEQ ID NO: 4171 - DNA, 539 bp, Homo sapiens
  misc_feature: GYAE6OF02H8VB0.39.31.C09.1.454.CMB.1.raw
  modified_base (330)..(330): a, c, t, g, unknown or other
  misc_feature (330)..(330): n is a, c, g, or t
  modified_base (443)..(443): a, c, t, g, unknown or other
  misc_feature (443)..(443): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaaacaataaagaattacttcgcttggtaccagcaagaaaccaggacagcctcctaagtgctacatttactgggcatcgtacccgggatcccggggtcctgaccgnttcagcggcaggcgggtctaggagacagtactttcaactctcaaccatcagcagcctgcaggctgaagatgtggctagttttatacttgtcagcagtattaatagtagtcctnagtacgttttcgggaccggggtaccaagcgttaggagagtaccgaaaacgacgtaggtaggctagccaaccactccttagtcttactacttccccg

SEQ ID NO: 4172 - DNA, 546 bp, Homo sapiens
  misc_feature: GYAE6OF02HBFRV.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtcctgaccgattcagcggcagcgggtctggagacagtatttcactctcaccatcagcacgcctgcaggctagaagtatgtggctagtttattacgtgtcagctagtattagtagtacgtccttcagttacgttttcgggaccggggtaaccaaggtccgtaggacgtagtaccgaaacgtaacgtgttacggcgttacgacctacgactccgttgtccttactcttcccg

SEQ ID NO: 4173 - DNA, 592 bp, Homo sapiens
  misc_feature: GYAE6OF02JF7WG.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctctaagttcgctcatttacngggacatcacccgggagtccggggtcctgaccgattcgacgcggcagcggtctgacgacagtatttcactcgtcaccatcagcacgcctgcacggctacgaagacgtggtacggctagtttattacgtcgtacgagctaagttattagttagtacgtccgttcgagttacgttttcgggaccggggtaaccaaacggtccgtagggtaacgtacgtaacgtaaacggtaacgttaggtacgggtacctacggtacctaacctacgttaccgttacggtttacctttaccgtaacttccccg

SEQ ID NO: 4174 - DNA, 508 bp, Homo sapiens
  misc_feature: GYAE6OF02I3GV2.39.31.C09.1.454.CMB.1.raw
  modified_base (354)..(354): a, c, t, g, unknown or other
  misc_feature (354)..(354): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctccctaagttgctcatttactgggcatcctacccgggagtcccggggtccctgaccgattcagcggcagcgggtctgagacngatttcactctcaccatcagcagcctgcaggctgaagatgtggctagtttattactgtcagcagtattagtagtatcctactagtacgttttggccggggacaagtcgtgagatacaacgaactgtgctgaccactacgtctgtcttcattccg

SEQ ID NO: 4175 - DNA, 547 bp, Homo sapiens
  misc_feature: GYAE6OF02IJ7NY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctctaagttgctcatttactgggcatctacccgggagtccgggtccctgaccgattcagcggcagcggtctgagacagatttcactctcaccatcagcagcctgcagctagaagatgtggctagttattactgtcagacagtattatagtacgtcctctagtacgttttcgggaccggggtaaccgaacggtcgtagggtagtataccgaaacgtaacgtacggtaggtaccgttcgaccgtaccgtacttaccgttcgtacctttccattaccccg

SEQ ID NO: 4176 - DNA, 653 bp, Homo sapiens
  misc_feature: GYAE6OF02JRFF1.39.31.C09.1.454.CMB.1.raw
  modified_base (406)..(406): a, c, t, g, unknown or other
  misc_feature (406)..(406): n is a, c, g, or t
  modified_base (619)..(619): a, c, t, g, unknown or other
  misc_feature (619)..(619): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacggggacatcgtgatgacccagtctccagactccctggctgtgtctctgggcgaggagggccaccgatcaactgcaagtccagcctagagtgttttacacaggtaccaacaataagaattacttacgcttcggtaaccagaccaagaaacccaggaacacgcctacctaaagttcgctactactttacgtggctagtccgtacccgggagtcccggggtccctaggaccgtacttcacgcggaccgacggcgggtactgaacgacacggtatttaccacttcnccgaccctaatccaagccacgtcctacgacgtacggctggaagtagtcggtaggactaagtttacgttaacgtcggtacacgtcgtagttaacttaagttagttacgttaccgtaccgtagttaccgtttacgggtacccgggggaaccctaaaggtcgacggtagtacgtaaccgaacgtaaccgttggtacggtacgtacggacctaccgngttaccgttaccgttcgttacctacgttaccccg

SEQ ID NO: 4177 - DNA, 536 bp, Homo sapiens
  misc_feature: GYAE6OF02FZTHI.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatccgtacccgggagtccggggtcctgaccgattcgagcggcaggcggtctgagacagtatttcactctcaccatcagcagcctgcaggctagaagtatggtgactagtttattactgtacagctagttattatagtagtcctactagttacgtttcgggaccggggtaaccaaggccgtaggagtactacgaaacgtaacgtggtggctcgcctactacttctgtccttacgacttcccg

SEQ ID NO: 4178 - DNA, 536 bp, Homo sapiens
  misc_feature: GYAE6OF02ISSIT.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttacnggcatcgtacccgggagtccgggtccctgaccgattcagcggcaggcggtctgagacagatttcactctcaccatcagcagcctgcaggctagaagagtgtggctagtttattactgtacagactagttattatagtagtcctacgagttacgtttcgggaccggggtaacaaggtcgtaggagactacgaaacgtaacgttggtaggctagaccacctacgtccttcgtccttactacttcccg

SEQ ID NO: 4179 - DNA, 638 bp, Homo sapiens
  misc_feature: GYAE6OF02HTZJ5.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaataagaattacttcgcttggtaccagcaagaaaccaggacagcctctaagtgctcatttacngggacatcgtacccggggacgtcccgggggtccctgaccgtattcgacgcggacaggccgggtctggacgacagtactttcaacttcaccaaccactacacgtcaacgcctgaccgacgggtctaaggaagtagtgggtcggtacttaggtttttaattaccgttgtacgaagtaccttaagttaagtttaattaacggttacggttcccttagtaacggtttaccggttttacgggggacccggggtaactaacgggccgttagggaatacgtaaccgaaacggtacgtcgggtcggacttcggacctaaccgtagtccttcggttccttacgtactttccccg

SEQ ID NO: 4180 - DNA, 531 bp, Homo sapiens
  misc_feature: GYAE6OF02JBAWA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaaactgcaagcccagccagagtgtttacacaggtccaacaataagaattacttcgcttggtaccagcagaaaccaggacagcctcctaagttgctcatttactgggcatctacccggagtccgggtcctgaccattcagcggcagcggtctgagacagatttcactctcaacgatcagcagcctgcaggctagaagactgtggactagtttatactgtacagctagtagtatagtacgtacctctagtaacttttgggccggggtaacaacggctaggagactcgtaaaacgtgtagtcgggcttagccgtaacctacgttctggtaccttacgattacccg

SEQ ID NO: 4181 - DNA, 523 bp, Homo sapiens
  misc_feature: GYAE6OF02F9E1Y.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctagaagatgtggctagtttattactgtcagcagttattatagtacgtcctcagtacgtttcgggccggggtacaacggtcgtaggagtactacgaaacgtaacgtggtacggctcgaccactattcgtgtcttcattcccg

SEQ ID NO: 4182 - DNA, 513 bp, Homo sapiens
  misc_feature: GYAE6OF02HIDUH.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttatactgtcagtcagtatatagtacgtcctcagtacgttttgggaccggggtaccaagcgtaggagtacgtacaaacggaactgtaggctgccacatctgtcttacacttccg

SEQ ID NO: 4183 - DNA, 517 bp, Homo sapiens
  misc_feature: GYAE6OF02F3FKC.39.31.C09.1.454.CMB.1.raw
  modified_base (430)..(430): a, c, t, g, unknown or other
  misc_feature (430)..(430): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtggctagtttattactgtcagctagtattatagtagtcctnagtcgtttgggccggggtacaggtcgtaggagtatacgaacgtaacgtgtcggcgtagaccacacgtccttgtccttcgacttcccg

SEQ ID NO: 4184 - DNA, 502 bp, Homo sapiens
  misc_feature: GYAE6OF02HBH6E.39.31.C09.1.454.CMB.1.raw
  modified_base (291)..(291): a, c, t, g, unknown or other
  misc_feature (291)..(291): n is a, c, g, or t
  modified_base (426)..(426): a, c, t, g, unknown or other
  misc_feature (426)..(426): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttacngggcatctacccgggagtccggggtccctgaccgattcagcggcagcgggtctgagacagatttcactctcaccatcagcagcctgcaggctgaagatgtggctagttattactgtcagcatatatagtagtctnagtactttggacgggtaccaagcgtgagatacaacgaactggtgctacgactaccagtacctgtacttcattcccg

SEQ ID NO: 4185 - DNA, 508 bp, Homo sapiens
  misc_feature: GYAE6OF02G75JC.39.31.C09.1.454.CMB.1.raw
  modified_base (390)..(390): a, c, t, g, unknown or other
  misc_feature (390)..(390): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcctacccgggagtcccggggtccctgaccgattcagcggcagcggtctgagacagatttcactctcacatcagcagcctgcagctagaagtntgtggctagtttattactgtcagctagtattatagtatctctagtcgtttgggccgggtaccagcgtggagatacgaaacgtaactgtcggctcgcaccatctcgtcttcacttcccg

SEQ ID NO: 4186 - DNA, 553 bp, Homo sapiens
  misc_feature: GYAE6OF02H38YB.39.31.C09.1.454.CMB.1.raw
  modified_base (330)..(330): a, c, t, g, unknown or other
  misc_feature (330)..(330): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgaccccagtctccagactccctggctgtgtctctgggcgagagggccaccatcaactgcaagtccagccagagtgttttacacaggtccaaacaaataagaaattacttcgcttggtaccagcaagaaaccaggacagcctcctaagttgctcatttactggcatctacccgggagtccgggtccctgaccgnttcagcggcagcggtctgagacagatttcactctcaccatcagcagcctgcgaggctagaagattgggtgctagttttattacgtgtacagctagttatagtagtactctacagtacgtttgggaccggggtaacaaggcgtaggaagtacgtacaaacggtaccttggtacggcgtacgacccaccgtacgttccttaggttcctttaccgacctttccccg

SEQ ID NO: 4187 - DNA, 504 bp, Homo sapiens
  misc_feature: GYAE6OF02G9C51.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtacgtttgggcccggggtaccaaggctggagatacaaacgactgtggctgccaccatctgtcttcattccc

SEQ ID NO: 4188 - DNA, 600 bp, Homo sapiens
  misc_feature: GYAE6OF02JVZFT.39.31.C09.1.454.CMB.1.raw
tcagtcgcactagtcacgaccggtgctcgatttagacgtctcatcaaggaaggaaggggcgagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacactaggtccaacaataagaattactacgcttcggtaccagacagaaaccaggacacgacctactaacgtgctctagttactggacagtctacccgggacgtcccggggtcctcgaccgtattccgagcggcgagcgggtctaggacgacgagtactttcgacttcgtccaacctacgtacacgcaggccctggcacgggctacggaaagtattcggtacggtcctagtttattacgtgtactagctagttattagtacgtatacctcgtagttacgtttcgggacccggggtaccgaaagtcgtaggagtaacgtccgaaacggtaacttggtgccgttacgccgtaacctacgtccgttagtttccgttataccttccccgg

SEQ ID NO: 4189 - DNA, 546 bp, Homo sapiens
  misc_feature: GYAE6OF02HG4NM.39.31.C09.1.454.CMB.1.raw
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
  modified_base (395)..(395): a, c, t, g, unknown or other
  misc_feature (395)..(395): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagaattacttcgcttggtaccagcaagaaaccaggacagcctactaagttgctacatttactgggcatccgtacccgggngtcccggggtcctgaccgattcagcggcaggcggtctgagacagactttcactctcaccatcancagcctgcagctgaagntgagctagtttattacgtgtacagtcagttattaagtagtactcctctacgtcgtttacgggccggggacaagtcgtaggaagacgtaacgaacgtaacgtggtcggtacgtacgacctaccgtacttccgttcgtacttcctacttcccg

SEQ ID NO: 4190 - DNA, 578 bp, Homo sapiens
  misc_feature: GYAE6OF02ITPJ8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctctatttacgtgggcatccgtacccggggaggtcccggggtccctgaccgtattcagcggcaggcggtctgagacagtactttcactctcaccatcagcacgcctgcaggctagaagtagtgtggactagtttattacgtgtcagctagttattagtagttactacctactagttaccggttttggggacccgggggtaacaacggtcgtagggtaagtacttaacgaaacggtaaccgttaggtcggtacgttcgacctaaccgtcgtccttggttcctttaccactttccccgg

SEQ ID NO: 4191 - DNA, 545 bp, Homo sapiens
  misc_feature: GYAE6OF02H0VGP.39.31.C09.1.454.CMB.1.raw
  modified_base (395)..(395): a, c, t, g, unknown or other
  misc_feature (395)..(395): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcaagaaaccaggacagcctactaagttgctcatttactgggcatcgtacccgggagtcccggggtccctgaccgattcagcgcagcgggtctgagacagtactttcactctcaccatcagcagcctgcaggctagaagngtggtgactagttttatactgtcagctagtattagtagtacgttcctcgtagttcgtttcgggaccggggacaaggcgttaggaagtactacgaaacgtaacgtggtggacgtacgccaacctcttaccgttgtaccttctacttccccg

SEQ ID NO: 4192 - DNA, 499 bp, Homo sapiens
  misc_feature: GYAE6OF02FHWJV.39.31.C09.1.454.CMB.1.raw
  modified_base (292)..(292): a, c, t, g, unknown or other
  misc_feature (292)..(292): n is a, c, g, or t
  modified_base (361)..(361): a, c, t, g, unknown or other
  misc_feature (361)..(361): n is a, c, g, or t
  modified_base (388)..(388): a, c, t, g, unknown or other
  misc_feature (388)..(388): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaacccaggacagcctcctaagttgctcatttacngggcatctacccggagtccggggtccctgaccgattcagcggcagcgggtctgagacagatttcactcncaccatcagcagcctgcaggctgaagntgtggcagttattactgtcagcatattatagtagtcctcagtacgttttggccggggacaagcgtggagtagtacaacgtaactgtggctgcacgatctgtcttcattccg

SEQ ID NO: 4193 - DNA, 514 bp, Homo sapiens
  misc_feature: GYAE6OF02HRBSG.39.31.C09.1.454.CMB.1.raw
  modified_base (295)..(295): a, c, t, g, unknown or other
  misc_feature (295)..(295): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaaataagaattacttcgcttggtaccagcaagaaaccaggacagcctcctaagttgctcatttacngggcatcctacccgggagtccggggtccctgaccgattcaggcggcaggcgggtctgagacagatttcactctcaccatcagcagcctgcaggctagaagatgtggctagtttattactgtcagcagtattatagtagtcctcagtacgtttgggaccggggtacaaagctaggagatacgaaacgtaactggtggctgcactatctgtcttacatccc

SEQ ID NO: 4194 - DNA, 529 bp, Homo sapiens
  misc_feature: GYAE6OF02HVJ8N.39.31.C09.1.454.CMB.1.raw
  modified_base (388)..(388): a, c, t, g, unknown or other
  misc_feature (388)..(388): n is a, c, g, or t
tcagtcgcactagtcacgaccggtgctcgatttagacgtctcatcaaggaaggaaggggcagcaagatggtgtttcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaaccaggacagcctcctaagttgctcatttactgggcatcctaccgggagtccgggtccctgaccgattcagcgcaggcggtctgagacagtatttcactctcaccatcagcagcctgcagctgaagntgtgctagtttatacgtgtctagtcagtaattagtagttcgtacctactagtcgtttcgggccgggtacaaggcgtgagatacaaacgacgtggtagtcgtcgacaccgtactcgttagttccttcgtacttccctacccg

SEQ ID NO: 4195 - DNA, 602 bp, Homo sapiens
  misc_feature: GYAE6OF02HBFLC.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctacctaagttgctcatttactgggcatcgtacccgggagtccggggtccctgaccgattcagcgcagcggtctgagacagatttcactctcaccatcagcagcctgcaggctagaagatgtaggctagtttatacgttgtcagtctaagttatttaatagttacgttccttacgtaacgttaccggtttttcggggacccgggggtaaaccaagggtacttaggggaacgtacgttaaccgaaaaccggtaacgttcggttacgggtaccttcggaccgtaacccgtaacgttccgtttacggtttccctttaccgacgttttacccccg

SEQ ID NO: 4196 - DNA, 521 bp, Homo sapiens
  misc_feature: GYAE6OF02IGUZR.39.31.C09.1.454.CMB.1.raw
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
  modified_base (356)..(356): a, c, t, g, unknown or other
  misc_feature (356)..(356): n is a, c, g, or t
  modified_base (391)..(391): a, c, t, g, unknown or other
  misc_feature (391)..(391): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgaccccagtctccagactccctggctgtgtctctgggcgagagggccaccatcaactgcaagtccagccagagtgttttacacaggtccaaacaataagaattacttcgcttggtaccagcaagaaaccaggacagcctcctaagttgctcatttacnggcatctacccgggngtccggggtccctgaccgattcagcggcaggcgggtctgagacagntttcactctcaccatcagcagcctgcagctgaagntgtgctagtttattacttgtacagctagtatagtagtacgtactcagttcgttttcgggccggggtaccgaagcgtaggagagtacgaaacgaacgtgtggcgtcgacacactctcgtcttctattcccg

SEQ ID NO: 4197 - DNA, 521 bp, Homo sapiens
  misc_feature: GYAE6OF02G28NI.39.31.C09.1.454.CMB.1.raw
  modified_base (392)..(392): a, c, t, g, unknown or other
  misc_feature (392)..(392): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttactgggcatccgtacccgggagtcccggggtcctgaccgattcagcggcaggcggtctgagacagatttcactctcaccatcagcagcctgcagctgaagatgngctagtttattacgtgtcagctagtattagtagtacgtcctcagtacgtttcgggaccggggtacaagcgtaggagtagtacgaaacgtacgtcgtggctcgaccacgtactctcgtcttcgattcccg

SEQ ID NO: 4198 - DNA, 755 bp, Homo sapiens
  misc_feature: GYAE6OF02JTI5K.39.31.C09.1.454.CMB.1.raw
  modified_base (568)..(568): a, c, t, g, unknown or other
  misc_feature (568)..(568): n is a, c, g, or t
tcagtcgcactagtcacgaccggtgctcgatttagacgtctcatcaaggaaggaagggcgagcaagatggtgttgcagaccaggtcttcatttctctgttgctctggatctctggtgcctacggggacatcgtgtatgaccagtctccagactccctgctgtgtctctgggcgagagggccaccgactcaactgcaagtccaagccagagtgttttacacacggtccaacaataacgaattacttcgcttacggtacagcagaaaccaggacagcctactaagtagctactatttacgtcgggacacgttccgtaacccggggacggttacccgggggttcccctacgggtaaccgttacgtttaccggtaacggtccggggaccgtaacgggtcccggggttccttacggggaacgtaaacccgtagggtaacctttttaccgaaccgttcgttcccaaccgttaactccggaacgtaccacggtcccgtacgaccgtacggtacgttacggaaagtacgttggtaccggggtacttaacggttttaactacgttacgtactacggngtacgtttaattacgtaacgttcgttaccgttacgtaacgttacggtttaccggggtaccgggggaactaaaggcgttaagggaccgtagtaaccgaaaacccggttaaggttaccggttagtaccgttacggaccgaacctttccgttaacgtttcgggtttaacccttacgttaaccttccccgg

SEQ ID NO: 4199 - DNA, 556 bp, Homo sapiens
  misc_feature: GYAE6OF02G39HW.39.31.C09.1.454.CMB.1.raw
  modified_base (392)..(392): a, c, t, g, unknown or other
  misc_feature (392)..(392): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgtattcacgccggcaggccgggtctgagacagtatttcactctacacctatcagcagtcctgcaggntagaagtatgtgctagtttacttacttgtcagtcagttatatagtacgtcctgtacgttacgttttgggacccggggtacaacggtcgtacgggagtacgtacgaaacgtaacgtggtaggtccgtacgaccgtaccagttcgtcgtccttactacttaccccg

SEQ ID NO: 4200 - DNA, 514 bp, Homo sapiens
  misc_feature: GYAE6OF02FK3TR.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcaggcgggtctgagacagatttcactctcaccatcagcagcctgcaggctagaagatgtggctagtttattacttgtcagcagtattatagtagtctactagtacgtttgggaccggggtaccaagcgtaggagactacgaaacgtaactgtggctgcacatcttgtccttctattcccg

SEQ ID NO: 4201 - DNA, 573 bp, Homo sapiens
  misc_feature: GYAE6OF02G3UYX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcaagaaaccaggacagcctcctaagttgctacatttactgggcatccgtacccgggagtcccggggtccctgaccgattcagcggcaggcggtctggagacagatttcactctcaccatacagacagcctgacgagctagaagatggtggacttagtttattacgtgttacagtacagttaattagtagttacgtcctacgtagttacggttttcgggacccggggtacgaagtcgtaggtagagtacgaaacggaacgttacggtacggacgtacgaccgtacctacttcgttacgttaccttacgtacttccccg

SEQ ID NO: 4202 - DNA, 558 bp, Homo sapiens
  misc_feature: GYAE6OF02ISP50.39.31.C09.1.454.CMB.1.raw
  modified_base (348)..(348): a, c, t, g, unknown or other
  misc_feature (348)..(348): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatcctacccgggagtccggggtcctgaccgattcagcggcagcggtctgaganagatttcactctcacatcagcagcctgcaggctagaagtagtgtggtctagtttattactgtcagtacagttattatagtagtcctagtacgtacgttttcgggaccggggtaccaaggtacgtaggacgtacgtaccgaaacggtaacgttacggtagggtcgtacgaccaccgtacgttcgttacgttacctttacctacttaccccg

SEQ ID NO: 4203 - DNA, 496 bp, Homo sapiens
  misc_feature: GYAE6OF02FQ12H.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcaggctgaagatgtggcagttattactgtcagcagtattatagtagtctcagtacttttggccggggtaccaagctggagatacaaacgaactgtggctgcacactctgtcttcattcc

SEQ ID NO: 4204 - DNA, 645 bp, Homo sapiens
  misc_feature: GYAE6OF02IA1RO.39.31.C09.1.454.CMB.1.raw
  modified_base (243)..(243): a, c, t, g, unknown or other
  misc_feature (243)..(243): n is a, c, g, or t
  modified_base (339)..(339): a, c, t, g, unknown or other
  misc_feature (339)..(339): n is a, c, g, or t
  modified_base (372)..(372): a, c, t, g, unknown or other
  misc_feature (372)..(372): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacgggacatcgtgatcgacccagtctccagactccctggctgtgtctctggcgagacggccaccatcaactgcaagtccagccagagtgttttacacaggtacaacaaataagaattactcgnttggtaccagcaagaaaccaggacagctctaagttgactactatttactggacacgtcgtaccggagtccggtccgtcgaccgtattcgacgcggngacgcggtctgagacagtatttcacgctcactntccagcacgtccagtcacggcttagaaagtagttcggagggtaccttaaggtttttacgtaacgttcgtaacctagtacgtaacgttaattaacgttaacgttacgtaccttacgtaacgtttacggttttccggggaaccggggtaacctaaaggtccgttaagggtaacgaacgttaaccggtaaaaccgtaacggtttacggacgtacgtaccgtaaccgtaccgttaacgtccgtttacggtacccgttttagacccgttttaaccccg

SEQ ID NO: 4205 - DNA, 557 bp, Homo sapiens
  misc_feature: GYAE6OF02JBWRG.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacactaggtaccaaacaataagaattactcgcttggtaccagcaagaaaccaggacagcctcctaagttgctctatttacgtggcatccgtaccgggacgtccgggtccctgaccgtattcgagcggcaggcggtctagacgacagtatttcactctcaccatcagcagcctgcagctagaagagtgtcgactagttattacgtgtctagactagtattatagtacgtacctagtacgttacggtttcggaccggggtacaaggtcgtaggaacgtactaacgtaaacgtaacgtggtacggtacgtcgaccgtactacgtcgttacgtcttacacttacccg

SEQ ID NO: 4206 - DNA, 510 bp, Homo sapiens
  misc_feature: GYAE6OF02HMDNN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatccgtacccgggagtcccggggtcctgaccgattcagcggcagcgggtctgagacagatttcactctcaaccatcagcagcctgcaggctagaagatgtggctagttattactgtcagtcagttatatagtagtcctcagtacgtttggccggggtaccaagcgtggagagtacaaacgaactgtggtctgacactatctgtcttcattcccg

SEQ ID NO: 4207 - DNA, 513 bp, Homo sapiens
  misc_feature: GYAE6OF02GSROV.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtcctgaccgattcagcggcaggcggtctgagacagatttcactctcaccatcagcagcctgcaggctgaagatgtggctagtttattactgtacagtcagtattatagtagtcctacagtacgtttgggccggggtacaggctggagactacaacgaacgtggtcggcgtgaccacctatcttcgtcttcattcccg

SEQ ID NO: 4208 - DNA, 578 bp, Homo sapiens
  misc_feature: GYAE6OF02JTKO7.39.31.C09.1.454.CMB.1.raw
  modified_base (415)..(415): a, c, t, g, unknown or other
  misc_feature (415)..(415): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttaggtaccagcagaaaccaggacaagcctcctaagttgctcatttaactgggcagtctacccgggtagtcccggggtccctcgaccgagttccagtcggcaggcgggtctggagacagtactttacgactcttcaaccctatacgacgacacgcctgccaggcctgaagntgtacggctacgtttattacgttgtacagcctagtaactattagtagtcctcgtagtacgtttcgggaccggggtactagtacgtagggaagtactacgaaacgtaaccgtagtacggtacgtagaccgtaacctacgtaccttgttaccttactattccccg

SEQ ID NO: 4209 - DNA, 563 bp, Homo sapiens
  misc_feature: GYAE6OF02JBVHW.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccgggtccctgaccgattcagcggcagcgggtctggagacagatttcactctcaccatcagcagcctgcaggctagaagagtgtggctagtttattactgtcagctagttattagtagttagtccttacgacgtacgttttcgggaccgggggtaccaaggtccgtagggagtacgtacgaaaccggtaacgttggtacgggtcgttacgaccgtaccgtacgttccgttgttacctttaccgtacttccccg

SEQ ID NO: 4210 - DNA, 541 bp, Homo sapiens
  misc_feature: GYAE6OF02GJUOE.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcaagaaaccaggacagcctcctaagttgctcatttactgggcatccgtacccgggagtcccggggtccctgaccgattcaggcggcaggcgggtctgagacagatttcactctcaccatcagcagcctgcaggctagaagatgtaggtctagtttattactgtacagctagtattatagttactcctacgtagtacgtttcgggaccggggtacaaggcgtaggagactacgaaacgtaacgtggtacggctcgacacctatccgttagtccttacacttccccg

SEQ ID NO: 4211 - DNA, 531 bp, Homo sapiens
  misc_feature: GYAE6OF02HTX0Q.39.31.C09.1.454.CMB.1.raw
  modified_base (344)..(344): a, c, t, g, unknown or other
  misc_feature (344)..(344): n is a, c, g, or t
  modified_base (395)..(395): a, c, t, g, unknown or other
  misc_feature (395)..(395): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcagaaaccaggacagcctctaagtgctctatttactggcatccgtacccgggagtccgggtccctgaccgattcagcggcaggcgggtntgagacagtatttcactctacaaccatccagcacgcctgcaggctagaagntgtggctagtttatactgtacagcagtatatagtacgtcctagtacgtacgtttgggaccggggtaacagtacgtaggagtactacgaaacgacgtaggtacggtctacgccacctatctcgttcttccattcccg

SEQ ID NO: 4212 - DNA, 510 bp, Homo sapiens
  misc_feature: GYAE6OF02FZ4XE.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctacagtacgttttgggccggggtaccaaggcgtaggagatacaaacgaactgtggctgaccacactctgtcttcattcccg

SEQ ID NO: 4213 - DNA, 593 bp, Homo sapiens
  misc_feature: GYAE6OF02JIIMG.39.31.C09.1.454.CMB.1.raw
  modified_base (294)..(294): a, c, t, g, unknown or other
  misc_feature (294)..(294): n is a, c, g, or t
  modified_base (364)..(364): a, c, t, g, unknown or other
  misc_feature (364)..(364): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagacagaaaccaggacagcctactaagttgctcatttacnggcatctacccgggagtcccggggtcctgaccgattcgagcggcagcggtctgagacagactttcactcncaccactcacgcagcctgcgaggctaggaagatcggtgactagtttattacgtgttacagctaagtattagtagtacgttaccgtactacgttacggttttacgggacccggggtaacaaggccgttagggaacgtacgttaaccggaaacgttaacggtaggttacgggacctacggtaccctaaccctagttacccttaggtttacccttaccgtactttaccccgg

SEQ ID NO: 4214 - DNA, 520 bp, Homo sapiens
  misc_feature: GYAE6OF02GFWD2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcagcgggtctgagacagatttcactctcaccatcagcagcctgcaggctgaagatgtggctagtttattactgtcagcagttattatagtagtcctctagtacgttttcgggaccggggtacaagcgtaggagtatacgaaacgaactggtacggctgacctaccactcgttgtcttcacttcccg

SEQ ID NO: 4215 - DNA, 578 bp, Homo sapiens
  misc_feature: GYAE6OF02HGZWI.39.31.C09.1.454.CMB.1.raw
  modified_base (291)..(291): a, c, t, g, unknown or other
  misc_feature (291)..(291): n is a, c, g, or t
  modified_base (393)..(393): a, c, t, g, unknown or other
  misc_feature (393)..(393): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagattacttcgcttggtaccagcagaaaccaggacagcctctaagttgctcatttacngggcatcgtacccgggagtccggggtcctgaccgattcagcggcaggcggtctgagacagtactttcacttctcaaccatcagcagcctgcaggctagaagngtgtgctagtttatacgttgtcagctaagttattaagtagtacgtcctacgtagttacgttttcggggacccggggtaaccaaacggtcgtagggaacgtacgtaacgtaaaccggtaacgttaggtacggtacgtcgacccgtaccgtacgttccgttaggtttccttaccgtactttaccccg

SEQ ID NO: 4216 - DNA, 533 bp, Homo sapiens
  misc_feature: GYAE6OF02HKQQ1.39.31.C09.1.454.CMB.1.raw
tcagtcgcactagtcacgaccggtgctcgatttagacgtctcatcaaggaaggaaggggcagcaagatggtgttgcagacccaggtcttcatttctctcttgctctggatctctggtgcctacggggacatcgtgatgacccagtctccagactccctggctgtgtctctgggcgagagggccaccatcaactgcaagtccagccagagtgttttacacaggtccaacaataagaattatttcgcttggtaccagcagaaaccaggacagcctcctaagttgctcatttactgggcatcgtacccgggagtccggggtccctgaccgattcagcggcaggcgggtctgagacagatttcactctcaccatcagcagcctgcaggctagaagatgtggctagtttattacttgtcagctagttattatagtacgtcctactagtacgttttcgggccggggtaccaagcgtggacgatacgaaacggtaactggtggactcgaccgacctattctcgttcttcctaccttcccg

SEQ ID NO: 4217 - DNA, 532 bp, Homo sapiens
  misc_feature: GYAE6OF02JULUJ.39.31.C09.1.454.CMB.1.raw
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtacccagcagaaaccaggacagcctcctaagttgctcatttacngggcatcctacccgggagtccgggtccctgaccgattcagcgcagcgggtctgacganagatttcgactctacacatcagcagcctgcaggcagacgtagtgtgtctagttagtctggtcagctaatatatagtacgtctacgtagttacgtttcggaccgggtactacgcgtagacgagtacgaacgtacctgtacgtcgttacgacgtactacgtactacgttctactacttacccg

SEQ ID NO: 4218 - DNA, 498 bp, Homo sapiens
  misc_feature: GYAE6OF02GDF9Q.39.31.C09.1.454.CMB.1.raw
  modified_base (292)..(292): a, c, t, g, unknown or other
  misc_feature (292)..(292): n is a, c, g, or t
  modified_base (327)..(327): a, c, t, g, unknown or other
  misc_feature (327)..(327): n is a, c, g, or t
  modified_base (429)..(429): a, c, t, g, unknown or other
  misc_feature (429)..(429): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcctacccggagtccggggtccctgaccgnttcagcgcagcgggtctgagacagatttcactctcaccatcagcagcctgcaggctagaagatgtggctagtttattactgtcagcatatatagtagtctanagtacgtttggaccgggacagcgtgagatacaacgtactgtggactgactacatctgtcttcattcccg

SEQ ID NO: 4219 - DNA, 564 bp, Homo sapiens
  misc_feature: GYAE6OF02I7UHB.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctacctaagttgctcatttacnggcatcgtacccgggagtccggggtccctgaccgattcagcggcaggcgggtctgagacagtatttcactctcacatcagcagcctgcaggctagaagatggtgctagtttattacgtgtacgagtctagttattatagttagtcctacgtagttacgttttcgggaccggggtaaccgtaacgtacgtaggtagactaaccgaaacggtaacgttaggtaggtccgtacggaccaacctacttccgttagttaccgttactacttccccg

SEQ ID NO: 4220 - DNA, 511 bp, Homo sapiens
  misc_feature: GYAE6OF02HCA20.39.31.C09.1.454.CMB.1.raw
  modified_base (427)..(427): a, c, t, g, unknown or other
  misc_feature (427)..(427): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcggtctgagacagatttcactctcaccatcagcagcctgcagctgaagatgtgctagtttatactgtcagcagtattatagtagtcctntagtacgtttggccggggtaacagcgtggagtatacgaaacgtacgtgtaggcgttcgacacctatccgtgtccttcattcccg

SEQ ID NO: 4221 - DNA, 542 bp, Homo sapiens
  misc_feature: GYAE6OF02HN5BK.39.31.C09.1.454.CMB.1.raw
  modified_base (355)..(355): a, c, t, g, unknown or other
  misc_feature (355)..(355): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgttttacacaggtccaacaataagaattacttcgcttggtaccagcaagaaaccaggacagcctcctaagttgctcatttactgggcatcgtacccgggagtccggggtccctgaccgattcagcggcagcggtctgagacagntttcactctcaccatcagtcacgcctgcaggctagaagatgtggctagtttattactgtcagtcagtattatagtagttcctactagtacgttttcgggaccggggtaaccgagtacgtggagacgttacgaaacgtaacgtcggtacggtctacgacaccgtacgtccttcggtcttcacttcccg

SEQ ID NO: 4222 - DNA, 617 bp, Homo sapiens
  misc_feature: GYAE6OF02JX8IC.39.31.C09.1.454.CMB.1.raw
  modified_base (583)..(583): a, c, t, g, unknown or other
  misc_feature (583)..(583): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccgatcaacgtgcaagtccagccagagtgtttacacaggtccaacaataagaattacttcgcttggtaccagcagaaaccaggacagcctacctaagtgtctactatttaccgtggcagtcctacccggggagtcccggggtccctacggtaccgattaccgacggtcggactaggtccgggtactggaacggacagtatttacgactactcgaaccctatccagaccgtagcccgtacgacacggtactacggaagtacgtggtacggtacgtaagtttacttacgtgttacaacgacgtattaagttacgttagtacgttcctcgtaagttcgtttacgggaccggggtacctaaaggtcgtcgaagtacgtacaacggtaacgtacgtggcgttanaccgtactataccgttagtacttcgtacttcccg

SEQ ID NO: 4223 - DNA, 531 bp, Homo sapiens
  misc_feature: GYAE6OF02ILHM0.39.31.C09.1.454.CMB.1.raw
  modified_base (290)..(290): a, c, t, g, unknown or other
  misc_feature (290)..(290): n is a, c, g, or t
  modified_base (524)..(524): a, c, t, g, unknown or other
  misc_feature (524)..(524): n is a, c, g, or t
tcagtcgcactagtcacgaccggtgctcgatttagacgtctcatcaaggaaggaagggcgagcaagatggtgttgcagacccaggtcttcatttctctgttgctctgatctctggtgcctacgggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctacctaagttgctcatttacnggcatcctaacccgggagtcccggggtcctgaccgattccaggccggcagcggtctggagacagtatttcactcactacataccagcacggtcctagcgaggctaggaacgagtgtacggactaggttttactacgtgtactagacctagtatatagtatcctacgagttactttcgggaccgggacaaagcgtagagactagaacgataggcgacgtgcacgtactctgtctnatacccg

SEQ ID NO: 4224 - DNA, 559 bp, Homo sapiens
  misc_feature: GYAE6OF02HSKDJ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcaagaaaccaggacagcctctaagttgctcatttactgggcagtcctacccgggagtcccggggtcccctgaccgtattcagcggcagcgggtctgagacagatttcactctcaccatcagcacgcctgcaggctagaagatgtggctagttttattacttgtcagactagtattattagttagtcctactacgtacgttttcgggaccggggtaaccgaagcgtagggagtacgtacgtaaacggtaacttggtacggtcgtacgaccacgtacttaccgtgtttccttactacttaccccg

SEQ ID NO: 4225 - DNA, 528 bp, Homo sapiens
  misc_feature: GYAE6OF02FYDBW.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcaggcggtctgagacagatttcactctcaccatcagcagcctgcaggctgaagatgtggctagtttattactgtcagctagtattatagttagtcctcagtacgttttcgggaccggggtaacaggctagggagtatacgaaacgtaactaggtcggactcgaccaccgtactccgttgtccttacacttcccg

SEQ ID NO: 4226 - DNA, 689 bp, Homo sapiens
  misc_feature: GYAE6OF02JZHGE.39.31.C09.1.454.CMB.1.raw
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
  modified_base (377)..(377): a, c, t, g, unknown or other
  misc_feature (377)..(377): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (437)..(437): a, c, t, g, unknown or other
  misc_feature (437)..(437): n is a, c, g, or t
tcagtcgcactagtcacgaccggtgctcgatttagacgtctcatcaaggaaggaaggggacgagcaagatggtgttgcaggaccaggtcgttcatttctctgttgctctggatctctggtgccgtacggggactagtcgtgatgaccagtctccagactccctggctgtgtctctgggcgaggacgggccaccgatccaactgaccaagtccagccagagttcgtttacactaggtccaacaataagaattacttacgcttgtaccagtacagaacagacacgcctactaacgtncgtactatttacgngggtacataccgtaccggtacggtccggggtcctacggaccgtacttccgagccggagacgcgggtcngagacacgtatttcgactctcaaccntaccngacgacgtcctagccaaggctaggaacgntcggtggacgtattttacgtacgtagtcaaggtcgtaaagttactttaaggtccgtttaaacgcccgttaacgtaacgttaccgttttacggggggtaacccgggggtaacggtaaagtccggggtaacgtaacggggtacgtttaaccggaaaaaccggtttcggttaacggggttcggacgggttaccttaccgaaccccgttagttacccgttaacggtttccggtttaccacgttttaaccccccggg

SEQ ID NO: 4227 - DNA, 512 bp, Homo sapiens
  misc_feature: GYAE6OF02HY6ER.39.31.C09.1.454.CMB.1.raw
  modified_base (306)..(306): a, c, t, g, unknown or other
  misc_feature (306)..(306): n is a, c, g, or t
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctctaagttgctcattactggcatctacccgggngtccggggtccctgaccgattcagcggcagcggtctgagacagatttcactctacaccatcagcagcctgcaggctagaagatgtgtactagtttattactgtcagnagtatatagtatcctnagtcgtttcgggccgggacagtcgtggatatacaaacgtaacgtgtacggctacgcacctatccgtgtacttacacttacccg

SEQ ID NO: 4228 - DNA, 608 bp, Homo sapiens
  misc_feature: GYAE6OF02IGOU6.39.31.C09.1.454.CMB.1.raw
  modified_base (442)..(442): a, c, t, g, unknown or other
  misc_feature (442)..(442): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaaataagaattacttcgcttggtaccagcaagaaaccaggacacgcctaccttaaagttcgcttctaattttacgtggggcctaagttcccgtaacccggggtacggttccccgggggttcccctaggacccgtacttccgaggccggcaggccggggtctggagacagtactttcactctcaaccatcacgcacgcctgcaggctagaagntgtgctagtttattactgtacagactagttattaatagttacgtctacgtagttacgttttacggggacccggggtaacaaggtcgtagggagtactaccgtaaacgtaacgtaggtcggaccttacgacctacctacgttccgttcgttacttccacgttccccg

SEQ ID NO: 4229 - DNA, 549 bp, Homo sapiens
  misc_feature: GYAE6OF02GQAF6.39.31.C09.1.454.CMB.1.raw
  modified_base (389)..(389): a, c, t, g, unknown or other
  misc_feature (389)..(389): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagntgtgctagtttattactgtacagctagtattagtagtagtcctatagttacgttttcggggacccggggtaacctaggtcgtagggagtactacgaaacggtaacgttaggtacggctacggacctaaccgtattccgttcgttcttccacgtttccccg

SEQ ID NO: 4230 - DNA, 684 bp, Homo sapiens
  misc_feature: GYAE6OF02GZC3G.39.31.C09.1.454.CMB.1.raw
  modified_base (130)..(130): a, c, t, g, unknown or other
  misc_feature (130)..(130): n is a, c, g, or t
  modified_base (137)..(137): a, c, t, g, unknown or other
  misc_feature (137)..(137): n is a, c, g, or t
  modified_base (162)..(162): a, c, t, g, unknown or other
  misc_feature (162)..(162): n is a, c, g, or t
  modified_base (194)..(194): a, c, t, g, unknown or other
  misc_feature (194)..(194): n is a, c, g, or t
  modified_base (224)..(224): a, c, t, g, unknown or other
  misc_feature (224)..(224): n is a, c, g, or t
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
  modified_base (419)..(419): a, c, t, g, unknown or other
  misc_feature (419)..(419): n is a, c, g, or t
tcagtcgcactagtcacgaccggtgctcgatttagacgtctcatcaaggaaggaagggcgagcaagatggtgttgcagacccaggtcttcatttctctgttgctctggattctctggtgcctaacggganatcggtnatgacccagtctccagtactcccgnggctgtgtctcgtgggacagcgggccaaccgnttcccaatgctaagtccaggccaagagttnttttaacacacggtccaaataataaagattacgtcacgttgtaaccngcctaagaaaccaggactagcctctaagtgcnactttagnggnacntaaccggntccgggtccncgatacgtcagaccggcaggtcggccgtanaccggatacgtaactttnacccttttcccgaaactacccggtatagggaacccncggtacccgtcgaccgtacggtactacggtaaacgtagtacgtaggtacgtagtttaacgtttacgtcgtacggtacgtagtaacgttaagttaacgtaagttaccgtccgttaactacgggtttaacgttaacggggtcccggtaaaccgtaacggtaacggtaggaaccggttataaaccggtaaaccgtaaacgggtacggttaccggtaccgtacggactacccggtaacttacgttccgtccggttaactccttacccgg

SEQ ID NO: 4231 - DNA, 530 bp, Homo sapiens
  misc_feature: GYAE6OF02FOKZ4.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctctaagttgctcatttactgggcatccgtacccgggagtccggggtccctgaccgattcagcggcaggcgggtctgagacagatttcactctacaccatcagcacgcctgcaggctagaagatggtcgactagttttattactgtcagctaagtattagtagttactcctactagttcgttttggggaccgggactaggtccgtaggagactacgaaacgtacgtgtcggctacgcacgtatcctgtcttacattcccg

SEQ ID NO: 4232 - DNA, 511 bp, Homo sapiens
  misc_feature: GYAE6OF02FKH68.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcaggcggtctgagacagtatttcactctcaccatcagcagcctgcaggctgaagtatgtggctagtttattactgtcagcagtattatagtagtcctcgagttacgtttgggaccggggacagcgtaggagagtacgaacgaactgtaggctgacactactctcgtcttcattcccg

SEQ ID NO: 4233 - DNA, 615 bp, Homo sapiens
  misc_feature: GYAE6OF02FGK9C.39.31.C09.1.454.CMB.1.raw
  modified_base (366)..(366): a, c, t, g, unknown or other
  misc_feature (366)..(366): n is a, c, g, or t
  modified_base (388)..(388): a, c, t, g, unknown or other
  misc_feature (388)..(388): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaaagttgctcattttactgggcatctacccgggagtccggggtccctgacccgtattcagcggcaggcgggtctgagacagatttcactcncaccatcagcagcctgcaggcngaagatggtcggactagtttaattaccgtgtcagacgtaagttatttacgtaagttacgtccgttactaacggttacgtttttaggggacccgggggtaacctaaacggtccgttacgggaacggtacgttaaccgaaaccggttaacgtcggggtacgggtaccgttacgggacctaacccgtaacgttccgttacggttccttttacccgtaacgtttcccccgg

SEQ ID NO: 4234 - DNA, 553 bp, Homo sapiens
  misc_feature: GYAE6OF02GLC4W.39.31.C09.1.454.CMB.1.raw
  modified_base (298)..(298): a, c, t, g, unknown or other
  misc_feature (298)..(298): n is a, c, g, or t
  modified_base (394)..(394): a, c, t, g, unknown or other
  misc_feature (394)..(394): n is a, c, g, or t
  modified_base (545)..(545): a, c, t, g, unknown or other
  misc_feature (545)..(545): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacactaggtaccaaacaataaagaattacttcgtcttaggtaccagcagaaaccaggacagcctcctaagttgctcatttacngggcatccgtacccgggaggtccggggtccctgaccgtattcgagcggcaggcggtctggagacagtatttcactctcaccatcagcgcgcgcagngtgagagtgtgtcgtacgttagttactacgtgagagcgtaagttatagtagtacctctagtacgtttacggtcggggaccgtaacgacggtcgagagtacgtaacgaacgtacgtggtcgtcgtcgaccgtactcgtacgttctacttacncgttcccg

SEQ ID NO: 4235 - DNA, 548 bp, Homo sapiens
  misc_feature: GYAE6OF02HLIKZ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcaagaaaccaggacagcctcctaagttgctctatttactgggcatcgtacccgggagtcccgggtccctgaccgattcagcggcaggcgggtctggagacagtactttcactctacaccatcagcacgcctgctaggactaggaagtagtggtaggtactagtttacttacgtgtcagtctaagttattagtagttacgtacctagtagttacgtttacgggaccggggacctaaggtctaggagatacgaaacgtaacgtgtcggctcgcactactctagtcttacgtctcccg

SEQ ID NO: 4236 - DNA, 518 bp, Homo sapiens
  misc_feature: GYAE6OF02INPGF.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcgtacccgggagtccggggtccctgaccgattcagcggcagcggtctgagacagatttcactctcaccatcagcacgcctgcaggctagaagatgtggctagtttattactgtcagctaagttattaatagtacgtcctacagttacgttttcgggccggggtaaccaagcgtggagactacaaacgaactgtggctgcaccatctcgtcttcattcccg

SEQ ID NO: 4237 - DNA, 518 bp, Homo sapiens
  misc_feature: GYAE6OF02HYBUQ.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttccatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtcccgggtcctgaccgattcagcggcagcgggtctgagacagatttcactctcaccatcagcacgcctgcaggctgaagatgtggctagtttattactgtcagcagtattatagtagtcctacagtacgtttcgggaccggggtacaaggcgtaggagtagtacgaaacgaactggtaggctgccactactcctgtcttcacttcccg

SEQ ID NO: 4238 - DNA, 677 bp, Homo sapiens
  misc_feature: GYAE6OF02JX22U.39.31.C09.1.454.CMB.1.raw
  modified_base (317)..(317): a, c, t, g, unknown or other
  misc_feature (317)..(317): n is a, c, g, or t
  modified_base (499)..(499): a, c, t, g, unknown or other
  misc_feature (499)..(499): n is a, c, g, or t
tcagtcgcactagtcacgaccggtgctcgatttagacgtctcatcaaggaaggaagggcagcaagatggtgttgcagacccaggtcttcatttctctgttgctctggatctctggtgctacgggacatcgtgatgacccagtctccagactccctggctgtgtctcgtggcgagacgggccacatacaactgacaacgtcagccagagttgtttacactaggtaccaacaactaaagaatttaacttcgtcgttacggtaaccaggacaacggaaaaccagggaacacgtcctacgtaagttcgctactatttacgnggacactcgtaaccgggcgttacccgggtcctcgtaaccgtattccgacggcggacgacggtcggtactaggacgtaacgaggttactttacgactacgttacgaaccctagtacgacgaccgaggtccctgacgtacggaccgttagaaacgtgttacgggtcgtaacgttacggttttanaccgtttgaccaggtcctaagttactagttaaacgtcggttacctacgtagttaaccggttttcggggaaccgggttaccctaaaggtccgtaaggacttacgaacgtaacgaaggttcggtacggtacctacggacctaacgttcgaccgtttacgttccttagtaccctttccccg

SEQ ID NO: 4239 - DNA, 590 bp, Homo sapiens
  misc_feature: GYAE6OF02H9PA0.39.31.C09.1.454.CMB.1.raw
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaacaataagaattactcgcttggtaccagcaagaaaccaggacagcctctaagttgctctatttacgngggcatccgtacccggggagtccggggtccctggaccgtattcagcggcaggcggtcngagacagtatttcactctcacancacgcagcctgcgaggctagaagtagtagtggctagttttacttacgttgtacgagtactagttattaagtacgtacgtcctcgtacgttacggttttacggggccggggtaaccaaaggtcgtaggtagtacgtacgaaaccggtaacgttaggtaggtcgtacgtacccgaaccttacgtacccgttaggttacctttacctacttaaccccg

SEQ ID NO: 4240 - DNA, 504 bp, Homo sapiens
  misc_feature: GYAE6OF02GMU80.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcagctgaagatgtgctagtttatactgtcagcagtattatagtagtcctcagtacttttcgggaccggggtaccaagcgtaggagatacaaacgaactgtcggctgcacatctgtcttcattcccg

SEQ ID NO: 4241 - DNA, 570 bp, Homo sapiens
  misc_feature: GYAE6OF02JHW3E.39.31.C09.1.454.CMB.1.raw
  modified_base (370)..(370): a, c, t, g, unknown or other
  misc_feature (370)..(370): n is a, c, g, or t
  modified_base (419)..(419): a, c, t, g, unknown or other
  misc_feature (419)..(419): n is a, c, g, or t
  modified_base (442)..(442): a, c, t, g, unknown or other
  misc_feature (442)..(442): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacgtgggcatcgtacccgggagtccggggtcctgaccgattcagcggcaggcggtctgagacagtatttcactctcacctancagcagcctgcaggctagaacgatggtggctagtttattacgtgtacancgtagtatagtagtacgtccttntacggtacgttttcggggacccggggtaactaacggtcgtaggaacgtacgtactaaaaccgggtaacgttaggtacgggtctcgacgtaacccgtattaccttggttaccttactacgtttaccccg

SEQ ID NO: 4242 - DNA, 515 bp, Homo sapiens
  misc_feature: GYAE6OF02FTJUU.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacnggcatctacccgggagtccggtcctgaccgattcagcggcagcgggtctggagacagtatttcactctcaccatcagcagcctgcaggctgaagatgtggctagtttattacgtgtcagcagttatatagtagtcctatacgtactttcgggaccgggtaacctaagcgtaggagtagtacgaacgtaactgtcggtctcgacaccgatctgtcttcattcccg

SEQ ID NO: 4243 - DNA, 617 bp, Homo sapiens
  misc_feature: GYAE6OF02IGUNP.39.31.C09.1.454.CMB.1.raw
  modified_base (448)..(448): a, c, t, g, unknown or other
  misc_feature (448)..(448): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagagttgttttaacacaggtaccaaacaataagaactttacttcgcttaggtaccaagcaacgaaaccaggaacacgtcctacctaagttcgctctaacttttacgtcgggctacgtccgtaccccgggggacgttaccccggggtcccctaggacccgtatttccgaacggccggtcacgggtcgggtctagacgactagtctttcactctcaacctatcagcacgctgcgagctagaagntgtggacttagtttatacgtgtacagtactagttatatagtacgttctacgagttacgtttcggggaccgggtaaccaggtccgtagggaactacgtaacgtaaacggtacgttggtcggtacttcgaccgtacctagttccgtagtttaccttccgactttaccccgg

SEQ ID NO: 4244 - DNA, 703 bp, Homo sapiens
  misc_feature: GYAE6OF02IS7QL.39.31.C09.1.454.CMB.1.raw
  modified_base (202)..(202): a, c, t, g, unknown or other
  misc_feature (202)..(202): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagctccctggctgtgtctcgtgggcgagacggccaccatcaactgcaagtccanccagagtgtttacacaggtaccaaacaataagaacttacttccgacttcggtaaccagcaacgaaaccgagacacgcctacctaagttgctactactttacgtgggactacgtaccgtacccgggacggttcccgggtccctggacccgtagttccgacggtccggacgacggccgggtacgtacggagtacccaggttactttaccgaaccttccgttaccacctaagttccaacggctaacgtcctgaccggagtcgtaagatagtaggtcggtctaaggtttaacttcgtacgtcgtacgtacctaagttaacgtttagttaggtaccttaccgtaattacgggttaacccggttttcgggggaaccgggttaaaccgaacggtcgggtacgttaacgtaccgtaaccgtaaaccggtaaaccgtttcgggtagggtcctaaccggtactaaccgttacgttccgttacctacccgtttacgttaaccctttccccgg

SEQ ID NO: 4245 - DNA, 543 bp, Homo sapiens
  misc_feature: GYAE6OF02H64FH.39.31.C09.1.454.CMB.1.raw
  modified_base (265)..(265): a, c, t, g, unknown or other
  misc_feature (265)..(265): n is a, c, g, or t
  modified_base (379)..(379): a, c, t, g, unknown or other
  misc_feature (379)..(379): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccnggacagcctctaagttgctcattactgggcatctacccgggagtccggggtccctgaccgattcagcggcagcgggtctgagacagatttcactctcaccatcagcagcctgcngctgaagatgtgctagtttattacgtgtcagctagttatatagtacgtacctcgagttacgtttcgggaccggggtaccaaggtcgtagggaatacgtaaccgaaacgtaacgttggtaggctgacctacctacgttccttaggttcctttaccgatttccccg

SEQ ID NO: 4246 - DNA, 567 bp, Homo sapiens
  misc_feature: GYAE6OF02HMB4L.39.31.C09.1.454.CMB.1.raw
  modified_base (290)..(290): a, c, t, g, unknown or other
  misc_feature (290)..(290): n is a, c, g, or t
  modified_base (322)..(322): a, c, t, g, unknown or other
  misc_feature (322)..(322): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagtgctcatttacngggcatccgtacccgggagtcccggggtcccnggaccgattcgagcggcaggcggtctggagacagtatttcactctaccaccatcagcacgctgcagcctagaagagtgtggtctagtttattacgttgtacagtctaagttattatagttacttacctacgtacgttacgttttcggggacccggggtaacctaaggcgttagggagacgtacgaaaccggtaacgtaggtcggacgttcgacctaccgatccgttgtccttacgtacttccccg

SEQ ID NO: 4247 - DNA, 570 bp, Homo sapiens
  misc_feature: GYAE6OF02F88Q5.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccctggctgtgtctctgggcgagagggccaccatcaactgcaagtccagccagagtgttttacacaggtccaacaataagaattacttcgcttggtaccagcagaaaccaggacagcctcctaagttgctcatttacngggcatccgtacccgggagttcccggggtccctagaccgtattcagcggcaggcgggtctgagacagtatttcactctcaccatcagcacgcctgcaggctagaagagtgtggtctagtttattacttgtcagactagttattatagttagtcctacgtagtacgttttcggggccggggtaaccaggtacgtaggacgtacgtacgaaacggtaacgtcggtacggtcgtacgacctaaccgtacgttccgttggttaccttaccgtacttccccg

SEQ ID NO: 4248 - DNA, 583 bp, Homo sapiens
  misc_feature: GYAE6OF02JTGS8.39.31.C09.1.454.CMB.1.raw
  modified_base (295)..(295): a, c, t, g, unknown or other
  misc_feature (295)..(295): n is a, c, g, or t
  modified_base (329)..(329): a, c, t, g, unknown or other
  misc_feature (329)..(329): n is a, c, g, or t
  modified_base (372)..(372): a, c, t, g, unknown or other
  misc_feature (372)..(372): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtccaaacaataagaattacttcgcttggtaccagcagaaaccaggacagcctctaagttgctactatttacgnggcatctacccgggagtccggggtcctagaccgnttcgagcggcaggtcggtctaggagacagatttcactctcacntcagcagcctgcgaggctagaagacgtgtacggctaaggtttattacgtgtacagtactagtattagagttagtaccttacgtagttacggttttacgggaccgggtaaccgtaacggtcgtacggtagacgtaacgtaaaccggtaacgttaggtagtccggtagtacccgaaccgtacttaccgttacgtccttacctacgttaccccg

SEQ ID NO: 4249 - DNA, 591 bp, Homo sapiens
  misc_feature: GYAE6OF02I7YD1.39.31.C09.1.454.CMB.1.raw
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (407)..(407): a, c, t, g, unknown or other
  misc_feature (407)..(407): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttacgcttggtaccagcaagaaaccaggacncgcctacctaagttgctactatttacngggcagtccgtacccgggagtcccgggtcctgaccgattcgagcggcacggcgggtctggaagacagtactttcacgtctacaccatcagcagcctgactagctagaagngtcgtagtctaagtttatacgtgtacagactagtattataagttactcctatacgttacgtttacgggaccggggtaccgtaagcgtaggaagtacgtaaccgtaaacggtaactcggttaaggacgtacggtaccgtaacccgtaacgttccgttacgttaccgttaccgtacgtttaccccg

SEQ ID NO: 4250 - DNA, 542 bp, Homo sapiens
  misc_feature: GYAE6OF02J2IX4.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtcccggggtccctgaccgattcagcggcagcggtctgagacagtactttcactctcaccatcagcagcctgcgaggctgaagatgtggctagtttatactgtcagctagtattatagtacgtcctctagtacgttttcgggacccggggtaaccaaggcgtaggagtacgtaacgtaaacggtaacgtggtcggtactcgaccacctacgtccgttcgtccttcacttacccg

SEQ ID NO: 4251 - DNA, 552 bp, Homo sapiens
  misc_feature: GYAE6OF02G2GOB.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgtttacacaggtaccaaacaataagaattacttcgcttggtaccagcaagaaaccaggacagcctctaagttgctcattacnggcatcgtacccgggagtccgggtccctgaccgtattcgagcggcgaggcgggtctgagacagtatttcactctccacatcgacgcagcctgcagctagagatggtgctagttatatgtacagtctagtattagtagttacgtacctagtacgttacggtttcgggaccggggtaccaaggtcgtagggatacgtaacgtaaacggagttcggtacggtctacgacctacgtactcgttcgttacttactacttccccg

SEQ ID NO: 4252 - DNA, 679 bp, Homo sapiens
  misc_feature: GYAE6OF02JLLK7.39.31.C09.1.454.CMB.1.raw
  modified_base (628)..(628): a, c, t, g, unknown or other
  misc_feature (628)..(628): n is a, c, g, or t
tcagtcgcactagtcacgaccggtgctcgatttagacgtctcatcaaggaaggaaggggcgagcaagatggtgttgcagaccaggtcttcatttctctgttgctctggatctctggtgcctacggggacatcgtgatgacccagtctccagacctccctggctgtgtctctgggcgagagggccaccatcaactgcaagtccagccagagttgtttaccacaggtccaaacaataaagaattactcgcttggtaccagtcagaaaccaggacagcctacaagttcactcatttacgtcggctaatccgtacccgggagttcccgggcccgtgacccgtattcgaacggtcggactaacgggccggttacgtggaacggtaaccagtaacttttcccgaactccgttaaccaacctagtaccgacgccacggccctacgacgacggtcgtagtaaacggacttaggtcgggactaacggttttacttactcgtacctggaacctaagtttactaacggttaagttacgttcccttacgaacgtttccggtttaacggggtccgggtaacccgaaagtaccggtgggtaaagacttaccggaaactaaccggtaggttccgggttaaccngggttaacccaccgtaacgttcccttgggttaccttacgttactccccggg

SEQ ID NO: 4253 - DNA, 541 bp, Homo sapiens
  misc_feature: GYAE6OF02G46S7.39.31.C09.1.454.CMB.1.raw
  modified_base (292)..(292): a, c, t, g, unknown or other
  misc_feature (292)..(292): n is a, c, g, or t
  modified_base (393)..(393): a, c, t, g, unknown or other
  misc_feature (393)..(393): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtcctgaccgattcgagcggcagcggtctgagacagatttcactctcaccatcagcagcctgcaggctgaagatgtgntagtttattacttgtcagactagtattattagtagttccttacagtacgttttcgggaccgggggtaccaacggcgtagggagtagtaacaaacggtaacgtggtacggacgtcgacaccgtactccgttgttccttctacttccccg

SEQ ID NO: 4254 - DNA, 610 bp, Homo sapiens
  misc_feature: GYAE6OF02GKXMP.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctacctaagttgctcatttactggcatcgtacccgggagtcccggggtcctgaccgattcacgcggcagcggtctgagacagatttcactctcacatcagcacgcctgcgaggctagaagatgtcgactagtttattactgtcagctagtattagttacgtacgttcccttacgtacgttaaccgttttcggggacccgggggtaaccgtaaacggtccgttaggggaacgtacgtaaccgtaaaaccggtaaccgttacgggttaggtacccgttacggacccgtaaacccgttacgttacccgttacggtttacccttttccgactttacccccgg

SEQ ID NO: 4255 - DNA, 546 bp, Homo sapiens
  misc_feature: GYAE6OF02IKRUO.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattactcgcttggtaccagcagaaaccaggacagcctcctaagttgctcatttactggctatcgtacccggagtccggggtcctgaccgattcgagcggcaggcggtctgacgacagtatttcactctaccacatcagcagcctgcacggctagaagtatgtcggtctagtttatacttgtacgtagctaagtattatagtacgttcctacgtagtacgtttacgggaccggggtaccagtccgtagacgatacgaacgtacgttagtcggtctacggacaccgtatcgttgttacttcctacgttcccg

SEQ ID NO: 4256 - DNA, 510 bp, Homo sapiens
  misc_feature: GYAE6OF02HWYML.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgctcatttacngggcatctacccggggagtcccggggtccctgaccgattcagcggcaggcgggtctgagacagatttcactctcaccatcagcagcctgcagctgaagatgtggctagtttatactgtcagcagtattatagtagtcctgagtacgtttgggccggggacaagctagggagtatacgaaacgacttggtcggctgccacatctagtcttcacttccc

SEQ ID NO: 4257 - DNA, 581 bp, Homo sapiens
  misc_feature: GYAE6OF02ID1YI.39.31.C09.1.454.CMB.1.raw
  modified_base (485)..(485): a, c, t, g, unknown or other
  misc_feature (485)..(485): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttaacacaggtaccaaacaaataaagaattacttccgcttcggtaccagcaagaaaccaggacagcctactaagttgctactattttacgtgggactacgttccgtacccggggtacggttcccggggtccctacggacccggtattcgaacggccggacacggccggggttactggaacgacagtactttcgactctacacatcagcagcctgcaggctagaagatgtgtctagtttattctagtcagtctagtattatagttactacctnaacgttacgtttacgggaccgggtacaaggcgtaggactacgtacaaacgtctacggtgaccgtagacctactacgttctgttacttcacttcccg

SEQ ID NO: 4258 - DNA, 520 bp, Homo sapiens
  misc_feature: GYAE6OF02FUX20.39.31.C09.1.454.CMB.1.raw
  modified_base (291)..(291): a, c, t, g, unknown or other
  misc_feature (291)..(291): n is a, c, g, or t
  modified_base (430)..(430): a, c, t, g, unknown or other
  misc_feature (430)..(430): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgttttacacaggtccaacaataagaattacttcgcttggtaccagcagaaaccaggacagcctcctaagttgctcatttacngggcatctacccgggagtcccggggtcctgaccgattcagcggcagcgggtctgacgacagatttcactctcacatcagcagcctgcagctgaagatgtggctagttattactgtcagactagtattatagtactctanagtcgtttcgggccgggtacagcgtggagtactacgaacggtaactggtacggtcgtagcgaccgattccgttcgtcttactagttcccg

SEQ ID NO: 4259 - DNA, 497 bp, Homo sapiens
  misc_feature: GYAE6OF02G1O73.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagcagtattatagtagtcctcagtacgttttggccggggaccaagctggagatacaaacgactgtggctgcacatctgtcttcatcc

SEQ ID NO: 4260 - DNA, 549 bp, Homo sapiens
  misc_feature: GYAE6OF02GGJJI.39.31.C09.1.454.CMB.1.raw
  modified_base (289)..(289): a, c, t, g, unknown or other
  misc_feature (289)..(289): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctgtctgtgtctctgggcgagagggccaccatcaactgcaagtccagccagagtgtttacacaggtccaacaataagaattactcgcttggtaccagcagaaaccaggacagcctcctaagtgctcatttacngggcatccgtaccgggagtccggggtcctgaccgattcagcggcaggcgggtctgagacagtatttcactctacaccatcagcagcctgcgaggtctagaagtagtggtggtactagtttattactgtcagacgtatattagtagttacgtcctacgtagttacgtttcgggacccgggtaacaaggtcgtaggagtactacgaaacgtacgtggtacggcctcgacctacctattaccgtgttccttactacttccccg

SEQ ID NO: 4261 - DNA, 525 bp, Homo sapiens
  misc_feature: GYAE6OF02IIM3W.39.31.C09.1.454.CMB.1.raw
  modified_base (291)..(291): a, c, t, g, unknown or other
  misc_feature (291)..(291): n is a, c, g, or t
  modified_base (428)..(428): a, c, t, g, unknown or other
  misc_feature (428)..(428): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaattgctcatttacngggcatctacccgggagtccgggtccctgaccgattcagcggcagcggtctgagacagatttcactctcaccatcagcagcctgcaggctgaagatgtggctagttttatactgtcagcagtattatagtagtcctnagtacgttttgggaccggggaccaaggtctaggagtataccgaaacgtaactaggtcggactgaccaccattccgtggttccttacacgtttccccg

SEQ ID NO: 4262 - DNA, 533 bp, Homo sapiens
  misc_feature: GYAE6OF02JAH7T.39.31.C09.1.454.CMB.1.raw
  modified_base (291)..(291): a, c, t, g, unknown or other
  misc_feature (291)..(291): n is a, c, g, or t
  modified_base (346)..(346): a, c, t, g, unknown or other
  misc_feature (346)..(346): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtacagcagaaaccaggacagcctctaagttgctcatttacnggcatctacccggagtcccgggtcctgaccgattcagcggcagcggtctgacganagatttcactctcacccatcagcagcctgcaggctagaagatgtgctagtttattacgtntcgancgtagtattatagtacgtcctgagtacgtttcggccggggtaaccaggtctaggagattaccgaaacgtaaccgtggtaggccttacgactaccgtacttcgtcgttacttactacgttccc

SEQ ID NO: 4263 - DNA, 547 bp, Homo sapiens
  misc_feature: GYAE6OF02HNQW3.39.31.C09.1.454.CMB.1.raw
  modified_base (362)..(362): a, c, t, g, unknown or other
  misc_feature (362)..(362): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaaccaggaacagcctcctaagttgctcatttacgtgggcatccgtacccgggagtcccggggtccctgaccgtattcagcggcgagcgggtctgagacgagtntttcactctcaccatcagcacgcctgcaggctagaagagtcgtggctagtttattacttgtacagactagttatagttagtagtcctgaacgttacgttttcgggacccggggtaccaagtcgtaggagtacgtacgtaaacggtactaggtcggctgacacctatctgtaccttctacttcccg

SEQ ID NO: 4264 - DNA, 536 bp, Homo sapiens
  misc_feature: GYAE6OF02HW2OW.39.31.C09.1.454.CMB.1.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgtttacacaggtccaacaataagaattactcgcttggtaccagcaagaaaccaggacagcctactaagtgctcattacnggcatctaccggagtccggtccctgaccgatcagcgcaggcggtctgagacagactttcactctcacatcagcacgtctgctaggctagaagatgtcgactagtttattactcgtcagctagtattatagtatcctacagtacgtttcggacggggtaccaagtcgtaggacattacgaaacgtaacgtggtcggtacgttacgccgaaccgtacgttactaggtttccttaccggtacttccccg

SEQ ID NO: 4265 - DNA, 539 bp, Homo sapiens
  misc_feature: GYAE6OF02HOV0J.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttgtaccagcagaaaccaggacagcctcctaagtgcccatttacngggcatcgtacccgggagtcccggggtccctgaccgtattcagcggcaggcgggtctgagacagtactttcactctcaccatcagcagcctgcaggctagaagatgtggctagtttatactgtcagctagtattatagttagtcctacgagtacgttttcgggaccggggtaccgaaggtcgtagggagactacgaaacgtacgtggtcggctcgacacctatccgttgttctactctccttaccccg

SEQ ID NO: 4266 - DNA, 557 bp, Homo sapiens
  misc_feature: GYAE6OF02IDCRE.39.31.C09.1.454.CMB.1.raw
  modified_base (403)..(403): a, c, t, g, unknown or other
  misc_feature (403)..(403): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaataagaattacttcgcttggtaccagcaagaaaccaggacagcctacctaagttgctcatttactgggcatacgtacccgggagtccggggtcctgaccgtattcagcggcacggcggtctgagacagtatttcactctcaccatcagcacgcctgcacggctagaagatgnggtactagtttattacgtgtcagtactagtattatagttagtcctctagttacgtttcgggaccggggtacaacggcgtaggagtacgtacgaaacggtaacgtaggtaggtccgtagacctacgtactaccgtgttccttacgtacttccccg

SEQ ID NO: 4267 - DNA, 630 bp, Homo sapiens
  misc_feature: GYAE6OF02GT6X3.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacagcctctaaagttgctcatttactgggcatcctacccgggagtccggggtccctgaccgattcagcggcaggcggtctgagacagtatttcactctcaccatcagcagcctgcaggctgaagatggtgtactaagttttattacgttgtacgagacgtaagtatttaagtaagttcgtacccttacgtaacggttaccggtttttaccggggacccggggggtaaccctaaacggtccggttagggtaacgtacgtaacccggtaaaaacggtaaccgttagggttacgggtaccgttacggtacccgtaaacctacgttacccgttacggtttaccgtttacccttacgtttaaccccccg

SEQ ID NO: 4268 - DNA, 585 bp, Homo sapiens
  misc_feature: GYAE6OF02HEI37.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagattacttcgcttggtaccagcagaaaccaggacagcctcctaagttgctcatttactgggcatctacccgggagtccggggtccctgaccgattcagcggcagcggtctgagacagatttcactctcaccatcagcagcctgctaggctagaagatgtgctagtttatactgtcagcagtatatagtagtacctcgtacgtaacttttcgggacccggggtaacctaaacggtcgtagggtaacgacgttaaccgaaaaccggtaacgttaacgggtcgggtacccgttaggaccccggtaacccgttaattacccgtttcggttacccttttaccgtaactttcccccgg

SEQ ID NO: 4269 - DNA, 575 bp, Homo sapiens
  misc_feature: GYAE6OF02JD9M4.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaaagttgactctatttactgggcatcctacccgggagtccggggtccctgaccggattcgacgcggccaggtccgggtactggacgaacagtatttcactctcacctatcagcagcctcgcaggctagaagatgtggctagtttattactgtcagctagtattaatagtactaccgtacgtagtacgttttgggacccgggtaccgtaaacgccgttagggacgtactacgtaaacgaacgttcgtaggacgttacggacctaaccgtatccgttacgtaccgtttctacgttaccccg

SEQ ID NO: 4270 - DNA, 519 bp, Homo sapiens
  misc_feature: GYAE6OF02GH0PX.39.31.C09.1.454.CMB.1.raw
  modified_base (291)..(291): a, c, t, g, unknown or other
  misc_feature (291)..(291): n is a, c, g, or t
  modified_base (387)..(387): a, c, t, g, unknown or other
  misc_feature (387)..(387): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacagggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttacngggcatctacccgggagtccggggtccctgaccgattcagcgcagcggtctgagacagtatttcactctcaccatcagcagcctgcaggctagagntgtgctagtttattactgtcagctagttattatagtatcctacagttacgtttcgggaccggggactaaggcgtaggactataaccgaaacgtactggtaggctagccactattcgtacgtccttatacccg

SEQ ID NO: 4271 - DNA, 563 bp, Homo sapiens
  misc_feature: GYAE6OF02F7XVB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcaggcgggtctggagacagtatttcactctcaccatcagcagcctgcaggctagaagatggtggctagtttattacttgtcagctagttatttagtagttacgtcctacgtacgttacgttttcgggaccgggggtaaccaaggtcgtagggtagacgtacgaaacgtaacgtcggtagggcctagacctaacctacgttaccttggttccttaccgtactttccccg

SEQ ID NO: 4272 - DNA, 596 bp, Homo sapiens
  misc_feature: GYAE6OF02I4EXP.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtcccggggtccctcgaccgacttcacggcggcagccgggtctgagacagatttcactctcaccatcagcacgctgcaggctagaagatggtggctagtttattacgttgtcgtacgtctaagttaactttaagtacgttacgttacccttacgtaacggttaccgtttttcggggacccgggggttaaccgtaaacggtacgtagggaacgtacgtaacgaaaccgtaaccgttggtacggtacctacgacctacgtacttacgtacgtccttaccgtacttccccg

SEQ ID NO: 4273 - DNA, 621 bp, Homo sapiens
  misc_feature: GYAE6OF02JZY1L.39.31.C09.1.454.CMB.1.raw
  modified_base (296)..(296): a, c, t, g, unknown or other
  misc_feature (296)..(296): n is a, c, g, or t
  modified_base (426)..(426): a, c, t, g, unknown or other
  misc_feature (426)..(426): n is a, c, g, or t
  modified_base (611)..(611): a, c, t, g, unknown or other
  misc_feature (611)..(611): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgtcttggtaccagcagaaaccaggacagcctacctaagttcgctctatttacgngggactagtccgtacccgggacggtccggggtccctagaccgattcgacgcggcgagcgggtctggacgacgagtactttaccgacttctaccaccactccagccagcctgcgaggtccgtaagaacgtnttcggtaggtacctaagtttttacgtacttggtacagtccgtaagttaattagtaagtacgttaccgttagtacgttacggtttcgggacccggggtaactaacggtacgtaggtacggtaactaccgaaacggtaaccgttggacggtaccgtcgaccctacgtactcttccgttactttaccncctttacccg

SEQ ID NO: 4274 - DNA, 573 bp, Homo sapiens
  misc_feature: GYAE6OF02GURDF.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagtgttttacacaggtaccaacaataagaattacttcgcttggtaccagcaagaaaccaggacacgcctacctaagttgctctatttacnggcatccgtacccgggagtcccggggtcctggaccgattcaggcggcgagcgggtctgagacagatttcactctacaccatcagcacgcctgcgaggctagaagtatggtggtacttagtttattacgtgtacagctagttattatagtacgtcctagtacgttacgtttacggggaccggggtaaccagtcgtagggagacgtaaccgaaacggtaactcggtacggtccgtagtaccacctacttccgttacgttacttacctacgttacccc

SEQ ID NO: 4275 - DNA, 526 bp, Homo sapiens
  misc_feature: GYAE6OF02F39GD.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtcctgaccgattcagcggcagcgggtctgagacagatttcactctcacatcagcagctgcagctagaagagtgtggctagtttattactgtcagctagttattagtagttacgtcctctacgtacgttttgggacccgggggtaacaacggtctagggagactacgaaacgtaacgtagtacggctcgcaccatactcgtcttcattcccg

SEQ ID NO: 4276 - DNA, 521 bp, Homo sapiens
  misc_feature: GYAE6OF02G3SD5.39.31.C09.1.454.CMB.1.raw
  modified_base (334)..(334): a, c, t, g, unknown or other
  misc_feature (334)..(334): n is a, c, g, or t
  modified_base (396)..(396): a, c, t, g, unknown or other
  misc_feature (396)..(396): n is a, c, g, or t
  modified_base (439)..(439): a, c, t, g, unknown or other
  misc_feature (439)..(439): n is a, c, g, or t
  modified_base (503)..(503): a, c, t, g, unknown or other
  misc_feature (503)..(503): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaaagttgctctatttacgtgggcatccgtacccgggagtcccggggtccctgaccgtnttcagcgcaggcggtctgagacagtatttcactctcaccatcagcagcctgcaggctagaangtgtgctagtttattactgtcagcagtattatagtacgtcctntagtacgtttcgggaccggggtacaaggtcgtggatagacaacgacgtggtgcgtacgctaccntctcgtcttacattcccg

SEQ ID NO: 4277 - DNA, 522 bp, Homo sapiens
  misc_feature: GYAE6OF02FTH8B.39.31.C09.1.454.CMB.1.raw
  modified_base (432)..(432): a, c, t, g, unknown or other
  misc_feature (432)..(432): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcaggcgggtctgagacagtatttcactctcacatcagcagcctgcaggctgaagatgtggctagtttattactgtcagctagtattatagtagtcctnacgtacgtttcgggccggggtaccagcgtaggagagtacgaaacggtaactggtacgcgtagcacctactccgtgtcttaccgattcccg

SEQ ID NO: 4278 - DNA, 548 bp, Homo sapiens
  misc_feature: GYAE6OF02F4LUS.39.31.C09.1.454.CMB.1.raw
  modified_base (348)..(348): a, c, t, g, unknown or other
  misc_feature (348)..(348): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcgagcggcagcgggtctganacagtatttcactctcaccatcagcagcctgcaggctgaacgatggtggtctagtttacttacgtgtcagtctagttattaatagtagtcctgtacgtacgttttcgggaccgggggtaaccaaaggtcgtaggagacgtacgaaacgtaacgtgtacggctacggacacctacgttcgtgttccttacactttaccccg

SEQ ID NO: 4279 - DNA, 576 bp, Homo sapiens
  misc_feature: GYAE6OF02HDOY4.39.31.C09.1.454.CMB.1.raw
  modified_base (410)..(410): a, c, t, g, unknown or other
  misc_feature (410)..(410): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcagaaaccaggacagcctctaagtgctctatttacgtggcacgtccgtacccggggacgtcccggggtccctgaccgtgttcgagcggcgaggcgggtctgacgactagtactttcacgtctacaacctatcagtcagcctgcaggcgtagaagntggtcgtactaagtttattacgtgtacgagacgtagttacttaattagtacttacctacgtagtacggttttcgggaccgggtaacgtaacgtcgtagggtagactaacgaaacggtaactgggtcgtcgtcgaccgtaccagttcgtcgtcttactacttccccg

SEQ ID NO: 4280 - DNA, 532 bp, Homo sapiens
  misc_feature: GYAE6OF02HRQ3K.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctctatttactgggcatccgtacccggggagtcccgggggtccctggaccgtattcaggcggcaggcgggtcctgagacagattttcactctcaccatcagcagcctgcaggctagaagatgtggctagtttattactgtcagcaagtattatagtactcctactacgtacgttttcgggaccggggtaaccaggcgtaggagatacgaaacgtactggtggctgccactctcgtcttcgttcattcccg

SEQ ID NO: 4281 - DNA, 563 bp, Homo sapiens
  misc_feature: GYAE6OF02GPR9D.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgctcatttacngggcatccgtacccgggagtccggggtccctgaccgtattcagcggcaggcggtctgagacagtatttcactctcaccatcagcagcctgcaggtctaggaagtagtgtaggtacgtaagtttacttacgttgtacagtctagttattatacgttacgtcctacgtagttacgtttcgggacccggggtaacaacggtcgtaggagtacgtacgaaacgtaacgtaggtcggtctacgaccacgtattccgtagtccttacgtattcccg

SEQ ID NO: 4282 - DNA, 659 bp, Homo sapiens
  misc_feature: GYAE6OF02JMX86.39.31.C09.1.454.CMB.1.raw
  modified_base (308)..(308): a, c, t, g, unknown or other
  misc_feature (308)..(308): n is a, c, g, or t
  modified_base (634)..(634): a, c, t, g, unknown or other
  misc_feature (634)..(634): n is a, c, g, or t
  modified_base (645)..(645): a, c, t, g, unknown or other
  misc_feature (645)..(645): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatcgacccagtctccagacctccctggctgtgtctcgtgggcgaggaggccaccatcaactgcaagtccagccagtagttgtttacacacggtaccaaacaataagtaattactcgacttacggtaccagacaacgaaaccaggacacgtcctactaagttgctctacttacgnggctacgtccgtaccgggacggttcccggtccgtcgaccgtacgttcgacggccggacgtacggcggtctagacgtactagttacttacgacctcctacctaccgtactacgaacgtaccgacgtccgtacggaccgtaggaccgttaaggaacgttgtaggtacgttactagttttacacgtgacagtactagtttactacgtagttccgttacctaggtaccgtttacgggtcgggaaccggtaactaggcgtaagtaacgactttaaaccggacggttagttggtacccgtacgtaccgaccttacggttacttcccggtttnttaaccccttnttacccgttccccg

SEQ ID NO: 4283 - DNA, 616 bp, Homo sapiens
  misc_feature: GYAE6OF02H0773.39.31.C09.1.454.CMB.1.raw
  modified_base (302)..(302): a, c, t, g, unknown or other
  misc_feature (302)..(302): n is a, c, g, or t
  modified_base (423)..(423): a, c, t, g, unknown or other
  misc_feature (423)..(423): n is a, c, g, or t
  modified_base (453)..(453): a, c, t, g, unknown or other
  misc_feature (453)..(453): n is a, c, g, or t
  modified_base (528)..(528): a, c, t, g, unknown or other
  misc_feature (528)..(528): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttacacaggtaccaaacaataagtaattacttccgcttaggtacagcaagaaaccaggacacgcctacctaagttgctacatttacngggtcagttccgtacccgggtagttcccggggtccctagaccgattcaggcgcgaggcggtctgagacagtatttcacgtctacactatacagcacgtcctgcgtacggctaggaaaggtntggtaggtacttacgttttaacttacgttntaccgatacgtaattaagttaattagttataccttacgtacgtttacgtttcggggacccgggtaacgaagtcgnggtaatgtaaaccgtaacgtaaacgttggtacggtaccgtacgaccctaacgtacgttaccgttactttccttaccgactttaccccg

SEQ ID NO: 4284 - DNA, 642 bp, Homo sapiens
  misc_feature: GYAE6OF02GRYS2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgtttacacaggtccaacaataagattactcgcttggtaccagcagaaaccaggacagcctcctaagttgctcatttactgggcatcgtacccgggagtccggggtcctggaccgattccgagcggcaggcgggtctgagacgagtatttcacgttcctcaccatccgaagtcgaacgccgtcgactggcttaggaagtagtgggttcggactaacgggttttactaccgttaggtaccgtaatcgtaaaggttaatttaacgtaaggttaacgttcccgttacgtaacgggtttaccgttttacggggacccggggggtaaacctaaaggtccggtacggtagtaacgttaccggtaaaacggtacttacggggtacggtacgttacgaccgtaacgtacttccggtacgtttacttaccctacgttaccccg

SEQ ID NO: 4285 - DNA, 578 bp, Homo sapiens
  misc_feature: GYAE6OF02GUVHA.39.31.C09.1.454.CMB.1.raw
  modified_base (234)..(234): a, c, t, g, unknown or other
  misc_feature (234)..(234): n is a, c, g, or t
  modified_base (301)..(301): a, c, t, g, unknown or other
  misc_feature (301)..(301): n is a, c, g, or t
tcagtcgcactagtcacgaccggtgctcgatttagacgtctcatcaaggaaggaagggggcaggcaagatggtgttgcagacccaggtcttcatttctctgttgctctggatctctggtgcctacggggacatcgtgatggacccagtctccagtactccctggctgttgtctctgggcgagagggccaccatcaactgcaagtccgagccagagtgtttacacgaggtccaanaataagaattacttcgcttaggtaccagcagtaaaccaggacagcctactaagtgactcatttacgngggcatccgtacccgggagtccggggtcctggaccgtattccgaggccggcaggtcgggttactggacgtacaggtattttacacgttctcaacctatcagccacgcctgctacgctagaagctggtgactagtttacttacgtgtacgacgtctagttattatagtacgtactacgtacgttacgtttcgggaccggggtacacggtcgtacggacgtacgtacgaacggtacgtagtacgtcgtcgactacgtatcttgtcttacgtagttcccg

SEQ ID NO: 4286 - DNA, 516 bp, Homo sapiens
  misc_feature: GYAE6OF02F1ZNW.39.31.C09.1.454.CMB.1.raw
  modified_base (289)..(289): a, c, t, g, unknown or other
  misc_feature (289)..(289): n is a, c, g, or t
  modified_base (386)..(386): a, c, t, g, unknown or other
  misc_feature (386)..(386): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctctaagttgctcatttacngggcatcgtacccgggagtccggggtccctgaccgattcagcggcagcggtctgagacagatttcactctcaccatcagcagcctgcaggctagaanatgtggactagtttattactgtcagcagtattatagtatctgagtacgtttcgggccgggacaacgcgtagggactatacgaaacgtactagtacggctagacacctagtccgtgtacttctacttcccg

SEQ ID NO: 4287 - DNA, 610 bp, Homo sapiens
  misc_feature: GYAE6OF02GMWSR.39.31.C09.1.454.CMB.1.raw
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaaacaataagaattacttcgtcttggtaccagcaagaaaccaggacagcctctaagtgctctatttactgggacatccgtacccggggaggtcccgggtccctcgaccgtattcaggcggcaggcggtctgacgactagtactttcnctcncaacctatcagcagcctgcgagctagagtgtggtgtacgtagtttagtcttagtcagactagtatttagtacgttacgtccttacgtaacgttccggtttaccggggaccgggggtaaactacggtacggtacggacgtaacgtaaccgtaaacggaacgttacgggtaccggtccgtaggaccccctaagtaccgttccgttaacggtttccttaccgtacgtttacccccg

SEQ ID NO: 4288 - DNA, 569 bp, Homo sapiens
  misc_feature: GYAE6OF02JB0G5.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttaccacaggtccaacaataagaattacttcgcttggtaccagcagaaaccaggacagcctacctaagttgctcatttacnggcatcctacccgggagtccgggtccctgaccgattcagcggcaggcggtctgagacagtatttcacgtctcaccatcagcagcctgcaggctagaagtatggtaggctagtttacttacgtgtcagtacagttattagtagtagtacctcgtacgttacgtttacgggaccggggtaccaaggtccgtagggacgacgttaacgaaaccgtaacggttcggtacggtccgtacgtaccaacccgtacttccgtagttaccttctacttccccgg

SEQ ID NO: 4289 - DNA, 539 bp, Homo sapiens
  misc_feature: GYAE6OF02JGVOF.39.31.C09.1.454.CMB.1.raw
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (408)..(408): a, c, t, g, unknown or other
  misc_feature (408)..(408): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctctaagttgctcatttacgtggcatctacccgggagtccgggtccctgaccgattcagcggcagcggtctgagacagtatttcactctacacctatcagcanccngcaggctagaagatggtgctagtttattacgtntcagcaagttatatagtacgtcctacagtacgtttgggaccggggtaccaagcgtaggaagtatacgaaaccggaacgtagtacgggtacttcgaacaccgaacttcgttcgtacgttaccacgtttcccg

SEQ ID NO: 4290 - DNA, 524 bp, Homo sapiens
  misc_feature: GYAE6OF02IN491.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaaataagaattacttcgcttggtaccagcagaaaccaggacagcctcctaagttgctacatttactgggcatcgtacccgggagtccggggtcctgaccgattcagcggcagcgggtctgagacagatttcactctcaccatcagcagcctgcaaggctagaagatgtgctagtttattactgtacagctagtaatagttagtagtacctcgagtacgttttcgggaccggggtaacaagcgtaggagagtacgaaacgtaactgtaggctcgacaccatctgtcttcattcccg

SEQ ID NO: 4291 - DNA, 566 bp, Homo sapiens
  misc_feature: GYAE6OF02HNAB6.39.31.C09.1.454.CMB.1.raw
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacngggcatccgtaccgggngtccggggtcccngaccgattcagcgcagcggtctganacagtatttcactctcaccatcagcagctgcagctagagagtgtgtctagtttatacgtgtacagtctagtattagttagtacgttacctacgtagttaccggttttgggacccggggtaacctaaaggccgttagggacgtagtaccgtaaaccggtaagttcggtacggtcctagacctaccgtacgtaccgttcgttaccttacctacgttaccccg

SEQ ID NO: 4292 - DNA, 555 bp, Homo sapiens
  misc_feature: GYAE6OF02J1Z3L.39.31.C09.1.454.CMB.1.raw
  modified_base (289)..(289): a, c, t, g, unknown or other
  misc_feature (289)..(289): n is a, c, g, or t
  modified_base (342)..(342): a, c, t, g, unknown or other
  misc_feature (342)..(342): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcagaggccaccatcaactgcaagtccagccagagtgtttacacaggtccaacaataagattactacgcttggtaccagctagaaaccaggacagtcctcctaagtgctacagttacngggcatcgtaaccggtagtccgggtcctgaccgattcagcgcagcggtctganacgagtatttcgactctaccactactcgagctaacgcctgacgaggtctagaacgagtgtacgtctagttacttacgtgtacgtacgtacagttatacgttacgtacgtcctacgttacgtacgtttacggccgggtaccgtagtcgtagagtacgtacgtaacgtactgtcgcgtacgaccgtactcgtcgttacgtcttacgagttacccg

SEQ ID NO: 4293 - DNA, 531 bp, Homo sapiens
  misc_feature: GYAE6OF02GPIGW.39.31.C09.1.454.CMB.1.raw
  modified_base (292)..(292): a, c, t, g, unknown or other
  misc_feature (292)..(292): n is a, c, g, or t
  modified_base (345)..(345): a, c, t, g, unknown or other
  misc_feature (345)..(345): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcgtacccgggagtccggggtcctgaccgattcagcggcaggcggtcngagacagatttcactctcaccatcagcagcctgcaggctgaagatgtggctagtttattacttgtcagctagtattatagtacgttcctactagttacgttttcgggaccggggtaacaaggtcgtaggacgactacgaaacgtaacgtggtcggctcgacctaccactcgtcgtcttcattcccg

SEQ ID NO: 4294 - DNA, 559 bp, Homo sapiens
  misc_feature: GYAE6OF02JHT7U.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcagtcgtacccgggagtccggggtcctgaccgattcgagcggcagcggtctgagacagtatttcactctcaccatcagcagcctgcaggctaggaagagtgtggactagtttattactgtacagtcgagttatagtagtacgtcctactagtacgttttcgggaccggggtaaccaaggtccgtagggacgtagtacgaaacggtacgtaggtacggtacgtcgaccgtacgtacgttccgttacggtccttcgtactttccccg

SEQ ID NO: 4295 - DNA, 559 bp, Homo sapiens
  misc_feature: GYAE6OF02FRUGH.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattactcgcttggtaccagcagaaaccaggacagcctcctaagttgctcatttacgngggcatccgtacccgggagtccggggtcctgaccgtattccagcggcaggcggtctggagacagtatttcactctcaccatcacgcagccgtgacaggctagaagagtgtaggtcgtagtttattacgtgtcagacaagttattagtagttagtcctacgtagttacgtttcgggaccggggtacaagtcgtaggagtactacgaaacggtagtacggtcggtacgtacgaccgtaccgtacttccgttgttccttactacttcccg

SEQ ID NO: 4296 - DNA, 571 bp, Homo sapiens
  misc_feature: GYAE6OF02GR5Q0.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctacctaagttgctcatttacgtggacatctacccggagtccggggtccctagaccgattcagtcggcacgtcgggtctagagactagtactttcactctacacctatcaacgcacgcctgcagctagaatatgtgctagttattactgctagactagtattacgtagtacgtcctactagttacgttttacggggaccggggtaacctaacggtcgtagggagtactaaccgtaaacggaacgttacggtacggtactcggaccaccttagttcttacgttccttactaccttccccgg

SEQ ID NO: 4297 - DNA, 529 bp, Homo sapiens
  misc_feature: GYAE6OF02GGT17.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatcgtacccgggagtccggggtccctgaccgattcagcggcaggcgggtctggagacagtatttcactctcaccatcagcagcctgcagctgaagatgtcggctagtttattactgtcagcagttatattagtagtctacgtagtacgttttcgggccggggaaccaaggtcgtggagactacgaaacgtaactggtggctacgacctactactacgttgtcttctacttcccg

SEQ ID NO: 4298 - DNA, 605 bp, Homo sapiens
  misc_feature: GYAE6OF02HP6RZ.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctactatttacngggcagtccgtacccgggagtcccggggtccctgaccgattcagcgcagcgggtctgagacagatttacactctacaccatcagcagcctgcaggctagaagagtgtggctagtttatactgtcagctagtattatagtactcctacgtagttacgttttcggggaccggggtaacccgaaggtaccgttagggaacgtacgttaaccgtaaaaccggtaacgttacgggtacgggtacccgttacggacccgtaacccggttaacgttacccgttacggttttaccctttaccgtacccttttacccccgg

SEQ ID NO: 4299 - DNA, 763 bp, Homo sapiens
  misc_feature: GYAE6OF02H3XP9.39.31.C09.1.454.CMB.1.raw
  modified_base (308)..(308): a, c, t, g, unknown or other
  misc_feature (308)..(308): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagagttgttttacacaggtaccaaacaaataagaattacttcgcttacggtaccagcaagaaaccaggacacgcctacctaagttcgctactatttaccgngggacctacgttccgtaacccggggtacgttccccggggtccctacggtacccgtaagttccgaaggtccggaccgagggtccgggttctaggtaacgacgtaggttactttccaaccgttcctcccaacctaagtaccgacgacctaccggtcccgttacggaccgtacgggtacctaaggtaaacgtaggttacgggttcggtaaccgtttaacggttttttaactaccggtttacgtaccggtaagtaccgttaaggttatttaaacgtacggttttaaccgtcccgttacgtaaccgggtttccgggtttttaaccgggggaccccggggtaaactaacggtcgttacgggaagtaccgtaaaccgtaaacggtacggttacggttcggaccgttaccgtaccgtaaccgtacttaccgtttaccggtttactttccctacgtttcccccg

SEQ ID NO: 4300 - DNA, 683 bp, Homo sapiens
  misc_feature: GYAE6OF02H3BCF.39.31.C09.1.454.CMB.1.raw
tcagtcgcactagtcacgaccggtgctcgatttagacgtctcatcaaggaaggaagggcagcaagatggtgttgtagaccaggtcttcatttctctgttgctctggatctctggtgcctacggggacatcgtgatgacccagtctccagactccctggctgtgtctcgtgggcgagacgggccacatcaactgcaagtccagccagagttgtttacacgtaggtccaaacaataagaattacttcgcttaggtaccagtacaagaaaaccgaggactagcctacctaagttcgctacatttacgtggacatccgtaccgggagtcccgggtcctggaccgattcgagccgcaggcggtctagacgaacgacgtattccgactcgtacacctaatcacgacgtacgtccctacgtacgaggtcctaagaagacgttaggtcgaccttaagtttacttacgtcgttacgaacgtgtaacgttagttaagtaacggttacgtaccgtacgtacggttaaccgttttccgggggaacccggggtaacctaaggtcggttaaggaacgtaacgttaacccgaaaacggttaaccgtcgggtaacggtaccgttacggaacccgtaaccgttacttaccggtttacggttaacccgtttaccgttaaccgttccccgtttaacccccgg

SEQ ID NO: 4301 - DNA, 492 bp, Homo sapiens
  misc_feature: GYAE6OF02I7CWW.39.31.C09.1.454.CMB.1.raw
  modified_base (290)..(290): a, c, t, g, unknown or other
  misc_feature (290)..(290): n is a, c, g, or t
  modified_base (386)..(386): a, c, t, g, unknown or other
  misc_feature (386)..(386): n is a, c, g, or t
  modified_base (423)..(423): a, c, t, g, unknown or other
  misc_feature (423)..(423): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagttgctcatttacngggcatctacccggagtccgggtccctgaccgattcagcggcaggcggtctgagacagactttcactctcaccatcagcagcctgcaggctgaagntgtggctagttatctgtcagcagtatatagtatcctnagtacgtttcggaccgggacagctggagagtacaacgacgtgtgactgctacactctgtctcagttccc

SEQ ID NO: 4302 - DNA, 581 bp, Homo sapiens
  misc_feature: GYAE6OF02IQ7PN.39.31.C09.1.454.CMB.1.raw
  modified_base (359)..(359): a, c, t, g, unknown or other
  misc_feature (359)..(359): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcaagaaaccaggacagcctcctaagttgctcatttactggcatcgtacccgggagtccggggtccctgaccgtattcagcggcaggcgggtactgagacagtntttcactctcaccatcacgcacgcctgcaggctagaagatgtggctagtttattacgtgtcagctaagttacttagtagtacgttccttacgtagttaccgttttcgggcccggggtaaccgtaacggtccgttaggacgtacgtaaccgaaaccggtaacgttggtacgggtacttacgaccgtacctacttaccgttgttacctttccgactttaccccg

SEQ ID NO: 4303 - DNA, 577 bp, Homo sapiens
  misc_feature: GYAE6OF02GZFEN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataaagaattacttcgcttggtaccagcagaaaccaggacagcctacctaagttgctctatttacgtgggcatccgtacccggggagtcccggggtcctgaccgattcagcggcaggcgggtctgagacagtactttcactctacaccatcagcacgtccgtgcgaggctaggaagagtgtggtcttagtttattacgttgtcgagtactaagttattaatagttacgttccctagtacgttacggtttcgggacccggggtaaccaagtcgtaggagtacgtacgaaacggtaacgttggtacggcgtacgccaccgtacttcgttcggtaccttactacttccccg

SEQ ID NO: 4304 - DNA, 560 bp, Homo sapiens
  misc_feature: GYAE6OF02IV6GT.39.31.C09.1.454.CMB.1.raw
  modified_base (294)..(294): a, c, t, g, unknown or other
  misc_feature (294)..(294): n is a, c, g, or t
  modified_base (371)..(371): a, c, t, g, unknown or other
  misc_feature (371)..(371): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctaccctaagttgctcatttacngggcatctacccgggagtcccggggtccctgaccgattcgagcggcaggcggtctgagacagtatttcactctcacntcagcagcctgcgagctagaagagtgtggtactagttttacttacgtgtcagctaagttattatagttacgttcctatacgttacggtttgggacccggggtaactaaggtctagggaacgtactacgaaacgtacgttggtcggtcgtcgacctaaccgtattccgtacgtcctttaccgattacccg

SEQ ID NO: 4305 - DNA, 558 bp, Homo sapiens
  misc_feature: GYAE6OF02F9DV7.39.31.C09.1.454.CMB.1.raw
  modified_base (529)..(529): a, c, t, g, unknown or other
  misc_feature (529)..(529): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccagacagcctcctaagttgctctatttactggcatccgtacccggagtccggggtccctgaccgattccagcggcaggcggtctgagacagtatttcactctcacctatcagccagcctgcaggctgaagtgtgtggctagtttattactgtacagctaagtatttaatagttacgtctacgtagttacgtttcggggaccggggactaaggtccgtagggactagtaccgaaacggtaacgttcgaggtcctacggaccaacccgtnttacccgttggtacccttcgtacttcccg

SEQ ID NO: 4306 - DNA, 556 bp, Homo sapiens
  misc_feature: GYAE6OF02GEC64.39.31.C09.1.454.CMB.1.raw
  modified_base (309)..(309): a, c, t, g, unknown or other
  misc_feature (309)..(309): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcctacccgggngtccggggtccctgaccgattcagcggcaggcgggtctgagacagtatttcactctcaccatcagcagcctgcaggctagaagagtggtggctagtttattactgtcagtcagttattatagtacgtcctacgtacgttacgttttcgggaccggggtaacctagtcgtaggacgtacgtaacgaaacgtaacgtggtacggtcgtacgaccacctacgttccgtacgttccttactacgttccccg

SEQ ID NO: 4307 - DNA, 515 bp, Homo sapiens
  misc_feature: GYAE6OF02FLKH2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttactggcatctacccgggagtccggggtcctgaccgattcagcggcagcggtctgagacagatttcactctcaccatcagcagcctgcaggctagaagatgtggctagtttattactgtcagcagtatatagtagtcctcagtactttggccggggtaccaagtctaggagacgtacgaaacgtaacgtgtacggctacgcaccgattccgtgtcttacgtattcccg

SEQ ID NO: 4308 - DNA, 615 bp, Homo sapiens
  misc_feature: GYAE6OF02HATPU.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagttgctcatttactgggcatccgtacccgggagtcccggggtccctggacccgattcaggccggcgaggcgggtctgagacagatttcactctcaccatcagccagcctgcaggctagaagatgtggactagtttattacgtgtcgagtactaagttatttaagttagttaacggtacctacgtacggttaccggttttacggggacccgggggtaaaccgtaggtaccgtagggtacgtacgtaaccggaaaaccggtaaccgtacggttacgggtaccgttacggtacccaacccgtacgttcccgttacggtttcctttaccgtactttacccccg

SEQ ID NO: 4309 - DNA, 605 bp, Homo sapiens
  misc_feature: GYAE6OF02FFDK0.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccacatcaactgcaagtccagccacgagtgttttacacaggtaccaacaataagaattacttcgcttggtaccagcagaaccaggacagcctctaagttgctcatttacgnggcatccgtacccggagtccgggtcctgaccgtattcaggcgtacaggcggtctgagcagtactttcactctacaccgatccgagcctaagccctcgcgaggtcgtagaagtagtcgtacggtacgtagtttacgttacgttgtactagtaccgtaagttattaagttaggttacgtcctacgtacgttacggttttcgggaccggggtaacacggtcgtacggtacgtacgtaccgaaacggtaacgttcggtacggtacgtacgtaccgtaccgtacgttaccgttacgttcccttactaccgttacccccg

SEQ ID NO: 4310 - DNA, 551 bp, Homo sapiens
  misc_feature: GYAE6OF02GESMZ.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatccgtacccgggagtccggggtcctgaccgattcagcggcaggcggtctgagacagatttcactctcaccatcagcagtcctgcaggctagaagagtgtggtctagtttattacgtgtcagctagttattagtagtacgttcctactagttacgttttcgggaccggggaacctaacggtcgtaggagtactacgaaaccgtaacgtaggtcggtcgtcgaccgtactacgttcctagttcttactacttcccg

SEQ ID NO: 4311 - DNA, 534 bp, Homo sapiens
  misc_feature: GYAE6OF02JM0OJ.39.31.C09.1.454.CMB.1.raw
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
  modified_base (468)..(468): a, c, t, g, unknown or other
  misc_feature (468)..(468): n is a, c, g, or t
  modified_base (509)..(509): a, c, t, g, unknown or other
  misc_feature (509)..(509): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacggggacatcgtgatgacccagtctccagactccctggctgtgtctctgggcgagagggccaccgatcaactgcaagtccagccagagtgttttacacaggtccaacaataagaattacttcgcttggtaccagcagaaaccaggacagcctctaacgttgctnatttanggcatctacccggagtccggggtccngaccattnagcgcagcggtctgagcagattcactctcacatcagcagcctgcagctgaagatgngcagtttattacngttacagacagtactatagttagtccttacagtacttttagggcccggggtaactaaacggcgttacggganaacgttacgaaacggtaaactggtggacgtgtcaacccgtntaccgtcggtacttacgattacccg

SEQ ID NO: 4312 - DNA, 584 bp, Homo sapiens
  misc_feature: GYAE6OF02FEQU8.39.31.C09.1.454.CMB.1.raw
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctacctaagttgctcatttacnggcatcgtacccggagtccgggtcctgaccgtattcgagcggnacggcgggtctgagacagtattcactcncacatcagcagcctgcagctagaagtatgtgtctagtttattactgtacgagacgtagttattagtacgttacgtcctacgtacggttaccgtttttacggggacccgggggtaaccaacggtcgtacgggtaagtactaaccgaaacggtaacgtggttacgggtacctacgaccgtaccgtagttacccgttgttacctttccgtactttacccccgg

SEQ ID NO: 4313 - DNA, 620 bp, Homo sapiens
  misc_feature: GYAE6OF02IB935.39.31.C09.1.454.CMB.1.raw
  modified_base (419)..(419): a, c, t, g, unknown or other
  misc_feature (419)..(419): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactcccgtggctgtgtctcgtgggcgagaggccaccatacaactgcaagtccagccagagttgtttacacaggtacaaacaataagaattacttcgcttcggtacagcaagaaaccaggacacgcctacctaagttcgctctaatttacgtgggcacgtaccgtaccggggacgtcccggggtccctggaccgattccaggcggtcaggcggtctaggagacagtatttcactctaccacatcacgcacgcctgcgacggtctagaagngttggagacttagttttacacgttggtacaacgcgtaagtattaagttacggtacgttaccctacggtaaggtttcggttttaccgggggacccgggggtaacctaaaggccgttagggatacgttaaccgaacgtaggttacggtccggactaggtaccctacctagttcccgttaggttcccttacgtacgttcccccg

SEQ ID NO: 4314 - DNA, 587 bp, Homo sapiens
  misc_feature: GYAE6OF02H6KR6.39.31.C09.1.454.CMB.1.raw
  modified_base (295)..(295): a, c, t, g, unknown or other
  misc_feature (295)..(295): n is a, c, g, or t
  modified_base (468)..(468): a, c, t, g, unknown or other
  misc_feature (468)..(468): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaataagaattacttcgcttggtaccagcagaaaccaggacagcctcctaagttgctcatttacnggcatccgtacccgggagtcccgggtcctgaccgtattcaggccggtcaggcgggtctggagacagtatttcactctcactatcacgcacgcctgacgacggtctagaagtagttgtcggtacttagttttacttacgttgtacagtctaagttattaagttagtacgtcctntacgttacgtttccggggaccgggtaccaggtcgtaggaagtacgtacgaaacggtcttcggtacgaccgttacgacctaccgtacttccggttcgttacctttaccactttacccccg

SEQ ID NO: 4315 - DNA, 556 bp, Homo sapiens
  misc_feature: GYAE6OF02HQNOB.39.31.C09.1.454.CMB.1.raw
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (393)..(393): a, c, t, g, unknown or other
  misc_feature (393)..(393): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccnggacagcctacctaagttgctcatttacnggcatctacccgggagtccgggtcctgaccgattcagcggcagcggtcnganacagatttcactctcaccatcagcacgcctgcaggctagaagatgtgntagtttattacgtgttacagtctagttattattaagttacgtcctagacgttacgttttacgggccggggtaaccaaggtcgtagggatacgtacgaaacgaacgtcggtaggtactcgaccgtacctagttccttacggtttaccttactaccgtttccccg

SEQ ID NO: 4316 - DNA, 545 bp, Homo sapiens
  misc_feature: GYAE6OF02GEPYD.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctacctaagttgctcatttacngggcatctacccgggagtccggggtcctgaccgtattcagcggcaggcggtctgagacagtatttcactcacacatcagcagcctgcagctgaagatgtaggctagtttacttacttgtcagcgtagttattaagtagtagtcctcagtacgttttacggggccggggacctaggcgtaggagtacgtacgaaacggtactaggtcggcgttacgactaccaagttccgtacggttccttacgactttccccg

SEQ ID NO: 4317 - DNA, 575 bp, Homo sapiens
  misc_feature: GYAE6OF02FR17R.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcgtacccgggagtccggggtcctgaccgattcagcggcaggcgggtctgagacagatttcacttctcaccatcagcacgcctgccgaggctagaacgatgtggctagtttattactgtcagctagttattatagttacgtcctacgtagttacgttttcggggacccgggggaacctaaaggtccgttagggagtacgttaaccgaaaacggtaacgtaggtacgggtacttggacccgaacctaacgttcctacggttctttccgactttcccccg

SEQ ID NO: 4318 - DNA, 629 bp, Homo sapiens
  misc_feature: GYAE6OF02JXSZT.39.31.C09.1.454.CMB.1.raw
  modified_base (438)..(438): a, c, t, g, unknown or other
  misc_feature (438)..(438): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacgggacatcgtgatgacccagtctccagactccctggctgtgtctctgggcgagagggccaccgatcaactgcaagtccagccagagtgttttacacaggtccaaacaataaagaattactcgcttggtaccagcagaaaccaggacagcctacctaagttcgctacatttacgtcgggcatccgtacccgggtaggtcccggggtacccctacggacccggtaattccgaacggtccgggacctacggccggggtctcggacggtacaagtactttcgactactccgacatcagcacgctgcacggctgaacgngtgtcggtctagtttatacgtgtacagtacagttataatagtcgtacctcgtagttaccggtttcgggacccggggtaacctaacgtacgtaggtaacgtacgtaacgtaaaacgtacgttacgggttacgtcggtacgtacccgaaccgttacgttacgttaccggttacctttacgtaccttaccccgg

SEQ ID NO: 4319 - DNA, 583 bp, Homo sapiens
  misc_feature: GYAE6OF02ISSSV.39.31.C09.1.454.CMB.1.raw
  modified_base (373)..(373): a, c, t, g, unknown or other
  misc_feature (373)..(373): n is a, c, g, or t
  modified_base (528)..(528): a, c, t, g, unknown or other
  misc_feature (528)..(528): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccacatcaactgacaagtccagccagagttgttttacacaggtaccaaacaaataaagtaattacttcgtcttcggtaccagacaagaaaccgaggacacgcctacctaagttgctactatttacgtgggctacgtccgtaacccggggacggttcccggggtccctcggacccgtattccgaggtccggngacggtcgggtctgacgacagtactttcactctacacctatcagcacgcctagacgagtctaggaagtagtggtcggtacttagtttacttacgtggtacagtctaattatattagtactctacgagttacgttcgggaccgggacagtgacganagtaacgaacgtaagtggacgtcgtcgactacctatcctcgtcttacacttcccg

SEQ ID NO: 4320 - DNA, 629 bp, Homo sapiens
  misc_feature: GYAE6OF02IR8HN.39.31.C09.1.454.CMB.1.raw
  modified_base (233)..(233): a, c, t, g, unknown or other
  misc_feature (233)..(233): n is a, c, g, or t
  modified_base (387)..(387): a, c, t, g, unknown or other
  misc_feature (387)..(387): n is a, c, g, or t
tcagtcgcactagtcacgaccggtgctcgatttagacgtctcatcaaggaaggaaggggcagcaagatggtgttgcagacccaggtcttcatttctctgttgcgtctggatctctggtggcctacggggacatcgtgactgacccagtctccacgactccctggcctgtgtctctgggcgagacgggccaccatcaacctgcagtccagccagtatgtttacacagtaccaanataagacttacttcgcttggaccagaccagaaaccaggaccagtaccctcgtaagtgtctctatttacgaggcacgtccgtaccgggtacggtccccgggtcctacggaccgtactccgcggaccggtacgcggtaccggtgtacgaacgtacngttactttacacctccgtaccacgtactacgccgacgcgccgtacgacggacggtacaggtaacgtagttggtacgtacgttacgtttactagttcgtacgtactgtaagttattagttacgtcgttaccgtacgtacggttcggtttacgggaccgggtacgacgcgtagactacgtaacgtaacggtcgttgtcggtattcgaccttacgacgttacgttcgtccttactccgttacccg

SEQ ID NO: 4321 - DNA, 628 bp, Homo sapiens
  misc_feature: GYAE6OF02HNVDF.39.31.C09.1.454.CMB.1.raw
  modified_base (426)..(426): a, c, t, g, unknown or other
  misc_feature (426)..(426): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtccaaacaataagaattacttcgcttggtaccagacaagaaaccaggacagcctctaagttcgctactatttactgggactacgtccgtaccccggggagtcccggggttcccctggaccgattcgaggccggacaggccggggtctgagacaggtactttcgactcctcaccatcagcagcctgcaggctagaagagtgtggnttaagtttattacgtgtacagtactaagttaattaagtacgttacgtaccgttacgtacggttaccgttttacggggacccgggggtaacctaaggtccgtagggtacgtaacgttaccgaaaaccggtaacgttagggtacggtaccgtacgaccgtacccgtacgttacccgttgtttacccgttacgtaccttaccccg

SEQ ID NO: 4322 - DNA, 530 bp, Homo sapiens
  misc_feature: GYAE6OF02GBCKX.39.31.C09.1.454.CMB.1.raw
  modified_base (290)..(290): a, c, t, g, unknown or other
  misc_feature (290)..(290): n is a, c, g, or t
  modified_base (427)..(427): a, c, t, g, unknown or other
  misc_feature (427)..(427): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctactaagtgctcatttacngggcatccgtacccgggagtccgggtcctgaccgatcagcgcagcgggtctgagacagtatttcactctacaccatcagcagcctgacagctgaagatgtggactagttattacgtgtctagactagtattatagtntcctatacgtacgtttgggaccgggtacacgtacgtgagtactacgaaacgtacgtaggtacgtccgtagcctaccgacgtacctgttccttactacttcccg

SEQ ID NO: 4323 - DNA, 585 bp, Homo sapiens
  misc_feature: GYAE6OF02HOB33.39.31.C09.1.454.CMB.1.raw
  modified_base (289)..(289): a, c, t, g, unknown or other
  misc_feature (289)..(289): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctctaagttgctcatttacngggcatccgtacccgggagtcccgggtcctgaccgattcaggcgcaggcggtctgagacagtatttcactctacacctatcagcacgcctgcgaggtctagaagagtgtaggtactagttttattacgttgtacagactaagttattagttaacgttacgtaccttacgtacgttacgttttcggggaccggggtaaccgaacggtacgtaggagtacgtaccgtaaacggtaacgtacggtacggtacgtacgactaccgtacgttaccgttacgttccttacgtaccgttcccg

SEQ ID NO: 4324 - DNA, 657 bp, Homo sapiens
  misc_feature: GYAE6OF02FYB3U.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacacggtccaacaataagaattaccttcgcttggtaccagcagaaaccaggacagcctacctaagttgctctatttacgtgggctacgtccgtacccggggacggtcccggggtccctgacccgtattccgaggccggcacggccggtctgacgactagtactttcacttcctacaacctactacagaccacgccgtcgacgacggctaggtaagtagtggtacggtacgttaagtttacgtttacttagtactacgtacgtagttattaagttagttacgttaccgttacgtaacgttaccggttttacggggacccggggtaaccgtaacggtcgtacgggtacgtagtaaccgtaaacggtaacgttacggtacggtacgttacggtaccctaccgtacggttaccgttcgtttaccgtttaccgtactttaccccg

SEQ ID NO: 4325 - DNA, 654 bp, Homo sapiens
  misc_feature: GYAE6OF02HSBJY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgttttacacaggtccaaacaataagaattacttcgcttaggtaccagcaagaaaaccaggacagcctacctaaagttgcctacatttactgggctatccgtacccgggagtcccggggtccctgacccgattcaggcggcaggcgggtctgagacagtatttcactcctcacctatcagcacgcctgacaggtactagaagtagtggtaggtacgttaacgttttattaaccttcgttcgaacgtacgtaacgtaattttaacgttagtttaacggttccctacgtaaggtttaccgttttagggggaccccggggtaacgaaggtaccgttaggggaacgtacgttaaccgaaaaccggttaacggtcggttacgggaccttacggtacccgaaccgttacgttaccttaggtttaccctttacgtaaccgttttcccccg

SEQ ID NO: 4326 - DNA, 541 bp, Homo sapiens
  misc_feature: GYAE6OF02IXWSI.39.31.C09.1.454.CMB.1.raw
  modified_base (288)..(288): a, c, t, g, unknown or other
  misc_feature (288)..(288): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttgtaccagcagaaccagacagcctcctaagttgctcatttacngggctagtcctacccgggagtccggggtccctgaccgattcagcggcagcggtctgagacagatttcactctcaaccatcagcagcctgcgaggctgaagatgtggctagtttattactgtcagtctagtattagtagtacgttctactagtacgttttagggcccggggtaaccgacgtgtggacgtagtaccgaaacgtaacgtggtacgggctcggacaccgtacttccgtagttccttctacgttcccg

SEQ ID NO: 4327 - DNA, 647 bp, Homo sapiens
  misc_feature: GYAE6OF02IN082.39.31.C09.1.454.CMB.1.raw
  modified_base (253)..(253): a, c, t, g, unknown or other
  misc_feature (253)..(253): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtcaacaataagaattactcgcttggtaccagnagaaaccaggacagcctactaagttgctactatttacgtggcatcgtaccggagtcccgggtcctgaccgattcagcgcagtcggtctgagacagtatttcactctacactactcacgtacacgtccctgacagggaccttaggaaagacgttggtacgggtacttaaggttttaatttaccgtacggtttacgaagtcgtaacgtttaactttaagttaagttacgtaccgttacgaaggtttaccgttttacggggaacccgggggtacctaaaggtccgtaagggtacgtacgttaaccgtaaaccggtaaaccgttacggtacgggtaccctacggaccctaaccgtaccgttaccgttacggtttactttaccgtacctttacccccgg

SEQ ID NO: 4328 - DNA, 596 bp, Homo sapiens
  misc_feature: GYAE6OF02H16X4.39.31.C09.1.454.CMB.1.raw
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaatgcagtccagccagagtgttttacacaggtaccaacaaataagaattacttcgcttggtaccagcaagaaaccaggacacgcctactaagttgctctatttactgggctagtccgtacccgggagttcccgggtccctagccgattcgacggcggcgaggcggtctggagacagtatttccnctctccaacctntacacgacacgcctgcaggctgaagatgtaggtctagttttatacgtgtacagtactaagtacttagtagttacgttacctacgtacgttacggttttccggggacccggggtaccgtaaaggtccgtagggaacgtagtaaccgaaacggtaacgtggttacggtcgtaggccctaccgtacgttccgttcgttctttactacgttccccg

SEQ ID NO: 4329 - DNA, 697 bp, Homo sapiens
  misc_feature: GYAE6OF02HH85B.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaaataagaattactcgcttggtaccagcaagaaaccaggaacagcctacctaagttgctctatttacgtgggactagtccgtacccggggacggttccccggggtcccctcggaaccgtacttcgaaggtccggacgacggccggggtctaggacgacgtaacggtattttaccaccttcctaccaacccgtaactccgaagaccacgcccttagaccgacgggactaggaaacggtcgttaggtcgggtattaagttttacttacgttgtaccgagtacgtaagtttaactttaagttacgttacgttacctacgtaacggttaccgttttcgggggacccggggtaacgtaacggtccgttaagggaacttacgtaaccgtaaaaccggtaacgttacgggttacggtacgtaccggtaccaaccgtacgttaccgttacgtttaccctttacacccgtttaccccgg

SEQ ID NO: 4330 - DNA, 573 bp, Homo sapiens
  misc_feature: GYAE6OF02FY5PV.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatccgtacccggagtccgggtcctgaccgattcagcggcagcggtctgagacagatttcactctcaccatcagcagcctgcgaggctagaagtagtggtggcgtagtttacttacgttgtcagactagttaattaagttagttacgttacctacgtagttacgttttacggggaccggggtaaccaacggtcgtaggagtagtacgaaaccgtaacgtcggtacggtcgtacgtaccaccgtacgttccgttcgttacctttacgtactttaccccg

SEQ ID NO: 4331 - DNA, 524 bp, Homo sapiens
  misc_feature: GYAE6OF02FP2CA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccagacagcctctaagttgctcatttactggcatctacccgggagtccggggtcctgaccgattcagcggcaggcggtctgagacagatttcactctcaccatcagcagcctgcagctgaagatgtgctagttattactgtcagcagtattagtagtagtacctcgagttactttcgggccggggtacacgtcgtaggagtactacgaacgtaacgtgtcggactgcctacctacttccgttcgttacttacgtacttaccccg

SEQ ID NO: 4332 - DNA, 551 bp, Homo sapiens
  misc_feature: GYAE6OF02GKOF3.39.31.C09.1.454.CMB.1.raw
  modified_base (309)..(309): a, c, t, g, unknown or other
  misc_feature (309)..(309): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatccgtacccgggngtcccggggtcctgaccgattcagcggcaggcgggtctgagacagtatttcactctcaccatcagcacgcctgcaggctagaagatggtggctaagtttattacgttgtcagctagtattattagttacgtcctacgtagtacgttttcgggaccgggggtaaccaaggcgtaggagtactacgaaacggtaacgtggtcggactcgactaccgtacttccgttgttccttactacttcccg

SEQ ID NO: 4333 - DNA, 598 bp, Homo sapiens
  misc_feature: GYAE6OF02FVHR9.39.31.C09.1.454.CMB.1.raw
  modified_base (289)..(289): a, c, t, g, unknown or other
  misc_feature (289)..(289): n is a, c, g, or t
  modified_base (396)..(396): a, c, t, g, unknown or other
  misc_feature (396)..(396): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcagacgggccaccatcaactgcaagtccagccagagtgtttacacaggtccaacaataagaattactcgcttggtaccagcagaaaccaggacagcctctaagttgctcattacgnggcatcgtacccgggagtccgggtcctgaccgattcgagtcggcacgcggtctgacgacagatttcgactccgtacaccatcgagcctacgcctgcaggctagaagntgtcggtctagtttacgttactgtacagtactaagttattatagttacgtccttacgtaagttaccgttttacggggacccggggtaaaccaacggtccgttaagggacgtaacgttaacggtaaaaccggtacggtacggttcggtaccgttacggacctaccgtagttcccgttagttacccgttcgtaccttaccccgg

SEQ ID NO: 4334 - DNA, 734 bp, Homo sapiens
  misc_feature: GYAE6OF02I2GWO.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttgttttacactaggtaccaaacaataagaattaaccttcgcgttcggtaccagacaacgaaaccgaggacagcccttaccgtaagttcgactctatttacgtgggctacgtccgacccgggtcggtcccggggtccctgaccgtacttcgaggccggacgaggtccgggtactaggacgactacgtacgttttcaccgttctaccaaccgtatccgacgcaacgtccgtcggacgacggccgtagtaagagttggtcggtacttaagttttactttacgttacgtacgtacgtacgtaatttaattaacgttaacggttaccgttaccgttacgttaacggtttaccgggtttttaccggggaccccggggggttaaacctaacggtaccggttaacggggaacgttaccgtaaccgggaaaaccggttaaccggtacggtacgggttcccgttaaccggtaacccgtaaccgttaccgttacccgttacggttttaccccttacgttaaccttacccccgg

SEQ ID NO: 4335 - DNA, 608 bp, Homo sapiens
  misc_feature: GYAE6OF02JJ4O8.39.31.C09.1.454.CMB.1.raw
  modified_base (296)..(296): a, c, t, g, unknown or other
  misc_feature (296)..(296): n is a, c, g, or t
  modified_base (517)..(517): a, c, t, g, unknown or other
  misc_feature (517)..(517): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaacaataagaattacttcgcttaggtaccagcagaaaccaggacagcctcctaagttgctctatttacgnggcatccgtacccgggagtcccgggtccctgaccgattcgagcggcaggcggtctgagacagtactttacactctaccaccatcgagcacgccgtcgtcgacggcgtagaagtagtgtggtacgtagtttacttacgtcgtcgacgactagttattagttagttacgttcctacgtacgtacgtttacgggtaccggggtaccggtacgtacgtacggtanaggggggggggggggggtaacaacggtaacgtagtacggtacgtcgtaccgtaccgtacgttaccgttcgttccgttacctaccttacccg

SEQ ID NO: 4336 - DNA, 559 bp, Homo sapiens
  misc_feature: GYAE6OF02JYM9X.39.31.C09.1.454.CMB.1.raw
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtcaacaataagaattacttcgcttggtaccagcagaaaccagacagcctcctaagttgctcatttactggcatctacccgggacggtccgggtcccgtcgaccgattcacggccggcagcgggtctgagacagntttcactcncaccatcagcagcctgcaggctgaagatgtcggactagttttattacgtgtacgtagacgtagtattattaagtcgttacctacgtaagttacgttttacgggccgggggtaacctaaggtcgtaggacgtaactacgaaacgtaacgtggtacggtctacgccaccttagtcctcgttacgttcctagttcccg

SEQ ID NO: 4337 - DNA, 600 bp, Homo sapiens
  misc_feature: GYAE6OF02H1PTX.39.31.C09.1.454.CMB.1.raw
  modified_base (396)..(396): a, c, t, g, unknown or other
  misc_feature (396)..(396): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagttgttttacacaggtccaaacaataagaattacttcgcttcggtaccagcaagaaccaggtacagcctcctaagttgctactatttaccgtgggctatccgtacccgggaggtcccggggtccctaggaccgagttcagcgcaggcgggtctggagacagtatttcactctccacatcgagcacgccngaccgtaggctagaagtagtgtacggtactagtttacttactcgtcagtactacgttattaattagttaacgttaccttactacggttaccgttttcggggacccgggggtaaccgaaggtccgtagggtagtactaccgtaaacggtaactggtacggtcgtacgaccgtaccgtatccgttcgttacttacgtacttccccg

SEQ ID NO: 4338 - DNA, 768 bp, Homo sapiens
  misc_feature: GYAE6OF02JRSXA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaaacaataagaattacttcgcttggtaccagcaagaaccaggacagcctactaagttgctacgtatttacgtggctatccgtaccgggtacgtcccggggtccctagaccgtattcgacggccggaccgaagggtccggggtcctaggtaaacggactaacggttactttaccaacttccgttaccgaaccctaagtaccgaacggcccgtaaacggtcccgtacggtccgaaacggtccgttaacggtaaacggtaagttcgggtacgggtaccgtttaacgggttttaactttaccgttacggtaccgtaacggtaccgttaaaggttaatttaaacggttaacggttaccgttaacccgtacggttaaccggtttaaccggttttaccgggggacccggggtaaaccgttaaacggtcgggttaacggaaccggtacgttaaccggtaaaccggttaacggttacgggtacggtaccgtacggtacccgtaaccggttacttaccggtaccgttttaccgttacctaccgtttaccccgg

SEQ ID NO: 4339 - DNA, 572 bp, Homo sapiens
  misc_feature: GYAE6OF02I6VSZ.39.31.C09.1.454.CMB.1.raw
  modified_base (299)..(299): a, c, t, g, unknown or other
  misc_feature (299)..(299): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacactaggtaccaaacaataagaattacttcgcttggtaccagcagaaaccaggacagcctacctaagttcgctctatttacgnggctatccgtacccgggaggtcccggggtccctgaccgtattcgagcggcaggcggtctgagacagtactttcactcncacntcagcacgctgcagctacgaagngtgtcgctagtttactactgtacagtctaagttacttagtaacgttacgtacctacgtacgttaccggttttacggggaccggggtaacaacggtcgtaggtacgtacgtacgaaacggtacgtggtacggtctacgactactacgtcgttcgtacttcctattcccg

SEQ ID NO: 4340 - DNA, 550 bp, Homo sapiens
  misc_feature: GYAE6OF02INQB8.39.31.C09.1.454.CMB.1.raw
  modified_base (351)..(351): a, c, t, g, unknown or other
  misc_feature (351)..(351): n is a, c, g, or t
tcagtcgcactagtcacgaccggtgctcgatttagacgtctcatcaaggaaggaaggggcagcaagatggtgttgcagacccaggtcttcatttctctgttgctatggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggacatccgtacccgggagtcccggggtccctgaccgattcagcggcagcggtctganacagtatttcactctacaccatcagcacgcctgcaggctgaagatgtggctagtttatactgtcagctagtattatagtagtcctacgtagttacgttttcgggaccggggtaactaacggtacgtaggtaagacgtacgaaacggtaactggtcggtctcgacctaccgtacgttcctgttaccttcctacttccccg

SEQ ID NO: 4341 - DNA, 504 bp, Homo sapiens
  misc_feature: GYAE6OF02GANOV.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacccctccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcagcggtctgagacagatttcactctcaccatcagcagcctgcaggctagaagatgtggctagtttattactgtcagcagtattatagtagtcctctagtacgtttgggccggggtaccagcgtggagatacgaacgtaactgtggctgcacatctgtcttcatccg

SEQ ID NO: 4342 - DNA, 533 bp, Homo sapiens
  misc_feature: GYAE6OF02JRJ2J.39.31.C09.1.454.CMB.1.raw
  modified_base (325)..(325): a, c, t, g, unknown or other
  misc_feature (325)..(325): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgaccagtctccagactccctggctgtgtctctgggcgagagggccaccatcaactgcaagtccagccagagtgtttacacaggtccaacaataagaattacttcgacttggtaccagcaagaaaccaggacagcctcctaaagttgctcatttactgggcatctacccggagtccgggtccctgaccnttccagcggcagccgggctcgagacagtatttcactctacacccatcagcagctgcagctgaanagtgngcagttacttatgtcagctagtatatagtagtcctagtagtacgtttacggtccggggaacaaggtcgtgagactacgaaacgtaacgtagtagggtcctacggacacccgtaagttccgtacgttcttaccagttccc

SEQ ID NO: 4343 - DNA, 565 bp, Homo sapiens
  misc_feature: GYAE6OF02I5UTS.39.31.C09.1.454.CMB.1.raw
  modified_base (348)..(348): a, c, t, g, unknown or other
  misc_feature (348)..(348): n is a, c, g, or t
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgacttggtaccagcagaaaccaggacagcctactaagttgctctattactgggcatcctaccggagtccggggtcctgaccgattcgagtcggcacgcggtctganacgagagtttcacgtctacacatcagcacgcctgcacggctagaagagtgcggntagttattcgngtcagtcgaagttactagtagtagtcctacgtagtacgttttacgggccggggtaaccaggctggacgtacgtacgaaacggtacgttagtcggtaccgtcggaaccgtaccctacgttaaccgttggtttaccttacgtaacgtttccccg

SEQ ID NO: 4344 - DNA, 550 bp, Homo sapiens
  misc_feature: GYAE6OF02HZPD8.39.31.C09.1.454.CMB.1.raw
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctctatttactgggctatctacccggggagtcccggggtccctgaccgattcagcggcaggcggtctagacgacagtactttcactcctcaccntcagcacgcctgcaggctagaagntgtggtactagtttacttactgtcaagctaagtattaatagtacgtacctacgagttacgtttgggacccgggaactaaggtcgtaggacagtaccgaaacgtacgtggtacggactcgaccgactatccgttcgtacttccgacttcccg

SEQ ID NO: 4345 - DNA, 616 bp, Homo sapiens
  misc_feature: GYAE6OF02HDME2.39.31.C09.1.454.CMB.1.raw
tcagtcgcactagtcacgaccggtgctcgatttagacgtctcatcaaggaaggaaggggcagcaaaatggtgttgcagacccaggtcttcatttctctgttgctctggatctctagtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatccgtacccgggagtccggggtcctcgaccgtattcagcggcaggcgggtctgagacagactttcactctcaccatcagcacgcctgacgaggctaggaacgtagtggtggtacttagttttatacgttgtacagtctaagttatttaagtacgtacgttcctacgtaaggttaccgttttcggggacccgggggtaacctaaacgggtccgttaagggaacgtacgtacgtaaaccggtaacgttgggtacggtcctacgacccgtaaccgttacgttaccgttacggttacctttacctaccttcccgttacccccg

SEQ ID NO: 4346 - DNA, 561 bp, Homo sapiens
  misc_feature: GYAE6OF02JEOUV.39.31.C09.1.454.CMB.1.raw
  modified_base (540)..(540): a, c, t, g, unknown or other
  misc_feature (540)..(540): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctctatttactgggcatccgtacccgggagtccgggtcctgaccgattcagcgcagcggtctgacgacagtatttcactctcaccatcagcagcctgcaggctagaagatgtgtctaagtttattacgtgtacagtctaagtattaattacgtagttccttagtacgttacgttttcgggaccggggtaaccaacggtcgtagggtacgtactacgaaacgtaacgtacggtggaccgtacgacaccgtattaccgtnttaccttactacctttacccg

SEQ ID NO: 4347 - DNA, 618 bp, Homo sapiens
  misc_feature: GYAE6OF02IKDOK.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaaataagtaattacttcgcttggtaccagcaagaaaccaggacacgcctacctaagttcgctctatttacgtgggctagtccgtacccgggagtcccggggtccctgaccgtattcacggcggcaggcgggtctgacgacagtactttcactctacacatcagcacgcctgcacggtctaggaagtagttggtggacttagttttacttacgttgtcagctaagttattaagtacgtacgtcctacgtaacggttaccgtttcgggggacccggggtaacctaaggtccgtagggtaacgtacgtaaccgaaaccgggtaacttagggtacggacgtacgaccgtaccgtaattacccgttcgttacctttcccgtacttcccccgg

SEQ ID NO: 4348 - DNA, 586 bp, Homo sapiens
  misc_feature: GYAE6OF02JD1ZQ.39.31.C09.1.454.CMB.1.raw
  modified_base (293)..(293): a, c, t, g, unknown or other
  misc_feature (293)..(293): n is a, c, g, or t
  modified_base (401)..(401): a, c, t, g, unknown or other
  misc_feature (401)..(401): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaacaataagaattacttcgcttggtaccagcagaaaccaggacagcctcctaagttgctcatttacgnggcatccgtacccgggagtccggggtccctgaccgtattcgagcggcaggcggtctgagacagtatttcactctacaccatcagcacgcctgcgaggctaggaacgtntggtcgtacgtagttttatactgtacagctagttattagtagtacgtcctagtagttaccggtttcgggacccggggtaacacggtcgtagggtaactacgtaaccgaaacggtaaccgttgggtaccggtcgtacggaccctaccgtacttccggttaccttaccgtttcctacgtttcccccg

SEQ ID NO: 4349 - DNA, 746 bp, Homo sapiens
  misc_feature: GYAE6OF02H8KVR.39.31.C09.1.454.CMB.1.raw
  modified_base (698)..(698): a, c, t, g, unknown or other
  misc_feature (698)..(698): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagaggccacatcaactgacaagtccagccagagttagtttacacacggtaccaaacaaataaagtaattacttcgtactttcggtaccagacaacgaaaaccaggaacaacggcccttactaaacggtttcgacttacctaacgttttacgtacggggacctactacccggtaacccgggggtacggtttccccgggggttaccccttacgggaacccgttaacgtttccgaacgggcccggggacgtaacggggtcggggttacgtacggacggaaccgtaaggtaacttttcgaaaccttcccttaccaaacccgtacttacgaccgtaccgaaccggtcctcgggaccgtaagggtaccttaggaaacgtaacgttgggtacgggtaccttaagggttttaataccggtttagaccgaagcgtaagttactagtaacgttaccgttcaacgtcgtttacggtttccgggaaccgggacgtacgacgttaggagactaacgtaaacgaggttaggtacgngttaaccgcgtaacctgttccgttacgttttactacctaccttcccgg

SEQ ID NO: 4350 - DNA, 536 bp, Homo sapiens
  misc_feature: GYAE6OF02FUK6D.39.31.C09.1.454.CMB.1.raw
  modified_base (292)..(292): a, c, t, g, unknown or other
  misc_feature (292)..(292): n is a, c, g, or t
  modified_base (482)..(482): a, c, t, g, unknown or other
  misc_feature (482)..(482): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcgtacccgggagtccggggtccctgacccgattccagcggcagcgggtctgagacagtatttcactctacaccatcagcagcctgcaggctagaagatgtgctagtttattactgtcagactagttattatagtacgtcctacgtagtacgttttcgggaccggggtacctaaggcgtaggganatacgaaacgtacgtggtacggctcgacaccgtatccgtcgtcttcacttcccg

SEQ ID NO: 4351 - DNA, 729 bp, Homo sapiens
  misc_feature: GYAE6OF02JYMBD.39.31.C09.1.454.CMB.1.raw
  modified_base (701)..(701): a, c, t, g, unknown or other
  misc_feature (701)..(701): n is a, c, g, or t
  modified_base (719)..(719): a, c, t, g, unknown or other
  misc_feature (719)..(719): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacgggccaccatccaactgacaagtccagccagagtcgtttacacaggtaccaacaataagaattactcgcttggtaccagcaagaaaccaggacacgcctacctaagttcgctacctatttacgtgggcctagttccgtaaccccggggtaggtttccccggggggtaccccttacgggtaacccggtaactttacccgaacgggtcccggggtaccaacggggtcccggggttcgttacgggaaacggttaccgaaaggtttaccgttttacccaaaccgtttcccgttacccaaaccctacgttccgaacggacctcggaccccgttgaccggaacgggtaccttagggaaaagtccgtgggttagggtaccttaaaggttttattaccgtgtactacgtactagttaatttagtacgttacgtcctacgtaacggttcggtttaccgggaccgggacctaaggcggttaagggcaacgtaacgaaaccggtaggtgtacggtctacggtaccaaccgtntccggttactctttaccnccgttacccg

SEQ ID NO: 4352 - DNA, 593 bp, Homo sapiens
  misc_feature: GYAE6OF02F5C0V.39.31.C09.1.454.CMB.1.raw
  modified_base (291)..(291): a, c, t, g, unknown or other
  misc_feature (291)..(291): n is a, c, g, or t
  modified_base (401)..(401): a, c, t, g, unknown or other
  misc_feature (401)..(401): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacagacctctaagtgctcatttacngggcatccgtacccggggacgtcccggggtccctgaccgtattccaggcggcaggcggtctagagacagtatttcactctcaccatcagcagcctgcaggctaggaagtntggtggctagtttattactgtacagtctagttattagttagttacgttcctagtacgttacgttttcggggaccggggaacctaggtaccgttagggaacgtagttaaccgaaaccggtaacgttagggtacggtaccgttaggacccttaaccgtacgttaccttacggttacccttctaacgttcccccg

SEQ ID NO: 4353 - DNA, 675 bp, Homo sapiens
  misc_feature: GYAE6OF02I3MP8.39.31.C09.1.454.CMB.1.raw
  modified_base (316)..(316): a, c, t, g, unknown or other
  misc_feature (316)..(316): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagtagttgttttacacgaggtaccaacaataagtaattacttcgcttacggtaccagacaacgaaaccgaggaacagccctaccgtaagttcgacctactactttacgngggtctacgtccggtacccggggtacggtcccggggtccctacggaccgtattcgacggcggcgacggtccgggtctggagacacgtactttcactcctacaacctactacgacgtcacgtccgtcgacgacggtcgtaggaagtagtcgggtagtacgtttaagtttaacgttactcgggtctaacggtaccttaagtttacgtttaacgtaaggttaccgttacccgttaggtaacggtttacgggtttaccgggggaccggggtaacctaggtacggtaggaacgtacgtaaccgaaacggtcgttggacggtctacgaccgtaacctgttccgttatccttaccgtcttaccccg

SEQ ID NO: 4354 - DNA, 757 bp, Homo sapiens
  misc_feature: GYAE6OF02GSDJM.39.31.C09.1.454.CMB.1.raw
  modified_base (285)..(285): a, c, t, g, unknown or other
  misc_feature (285)..(285): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctanatttactgggcagtccgtacccgggagtcccggggtccctgaccgtattcaggccggcaggccgggtctaggacgtacagtattttaccacgttcctccgaacctattccgacggtcctaacggtcccgtaggtccgtaacgggtcgttacggtaaacggtagttacggttacgggtaccgttaaggttttaacgtttacgttacggttacgtaacggtaccgtaaggtttaacgtttaagttaacggttaacggttacccgttaccgtaacggtttaaccggttttttaccgggggaacccggggggttaaccctaacgggtaccggtttacgggaacgttaccggttaaccggtaaaacccgggtaacggtttaaccgggtacggggttaccgttacgggtaccccgttaaccgttaaccgtttacccggtttacccggttttaccgtttacccgtacgttttacccccg

SEQ ID NO: 4355 - DNA, 631 bp, Homo sapiens
  misc_feature: GYAE6OF02H9TP2.39.31.C09.1.454.CMB.1.raw
  modified_base (271)..(271): a, c, t, g, unknown or other
  misc_feature (271)..(271): n is a, c, g, or t
  modified_base (336)..(336): a, c, t, g, unknown or other
  misc_feature (336)..(336): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagacctccctggctgtgtctcgtgggcgagaggccacatcaactgacaagtccagccagagtgtttacacaggtacaaacaaataagaattacttcgcttggtaccagcaacgaaaccagganacgcctactaagttgctctatttactggcactaccgtaccgggacgtcccgggtcctggaccgtnttacgacggccggcgacggcgggtctagagacgagtactttcaactctcaacctancgancacgcctgacgacgacgtaggaagtagttggtacggtaccgtagttttaacttacgtcgttacagtacttaacgtaattagttacgtttaacgtacctacgtacgttacggttttacgggaccggggtaaccgtaaacggcgtagggaacgtacgtaacggaaccggtaacttacggtcggtaccgtagacccgtaaccgtacttcgttacgttccttacgtcctttaaccccgg

SEQ ID NO: 4356 - DNA, 555 bp, Homo sapiens
  misc_feature: GYAE6OF02JAM5O.39.31.C09.1.454.CMB.1.raw
  modified_base (297)..(297): a, c, t, g, unknown or other
  misc_feature (297)..(297): n is a, c, g, or t
  modified_base (404)..(404): a, c, t, g, unknown or other
  misc_feature (404)..(404): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcagaaaccaggaccagcctcctaagttgctactatttacgngggcatccgtacccggggacgtcccggggtccctgacccgtattcgagcggcaggcgggtctgagacagtactttcactctacacatcagcagcctgcagctagagntgtgctagttatactgtcagctagttatatagtacgtcctacgtagttcgtttacgggaccggggtacacggcgtaggacgacgtacgaaacggtacgttcggtggacgttcgaccgtaccgtacttacgttcgtcttactacttaccccg

SEQ ID NO: 4357 - DNA, 508 bp, Homo sapiens
  misc_feature: GYAE6OF02FFS5X.39.31.C09.1.454.CMB.1.raw
  modified_base (376)..(376): a, c, t, g, unknown or other
  misc_feature (376)..(376): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctctaagttgctcatttactgggcatctacccggagtccgggtcctgaccgattccagcggcagcggtctgagcagattcactctcaccatcagcagctgcaggcngaagatgtggcagttattacgtgtcagcagtatatagtagtcctcagtacgtttcggccggggacctagtctggacgtatacgaaccgtaactgtacggcttgccactacgtctgtccttcgactttacccg

SEQ ID NO: 4358 - DNA, 550 bp, Homo sapiens
  misc_feature: GYAE6OF02FNXXF.39.31.C09.1.454.CMB.1.raw
  modified_base (430)..(430): a, c, t, g, unknown or other
  misc_feature (430)..(430): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaacaataagaattacttcgcttggtaccagcagaaaccaggacagcctcctaagttgctcatttactgggcatctacccgggagtccggggtcctgaccgattcagcggcaggcggtctgagacagtatttcactctcaccatcagcacgcctgcaggctagaagatgtggctagtttattctgtcagcatattatagtatcctnagttacgttttcgggacccgggggtaaccaaggcgtagggagtactaacgaaaccggtaacgtggtacggaccgttcgacccgaacctagttacctcggtttacccttactacttccccg

SEQ ID NO: 4359 - DNA, 568 bp, Homo sapiens
  misc_feature: GYAE6OF02HVPUH.39.31.C09.1.454.CMB.1.raw
  modified_base (295)..(295): a, c, t, g, unknown or other
  misc_feature (295)..(295): n is a, c, g, or t
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaaacaataagaattacttcgcttggtaccagcaagaaaccaggacagcctcctaagttgctcatttacngggactatcgtaacccggggtacgtcccgggggtcccctgacccgattcgagcggcaggcggtctgagacagtatttcatctacaaccntcagcagcctgcagcagaagatgtgntaagttttattactgtcagtctaagtatttaatagtacgttcctagagttaccgttttcggggaccgggaaccgtaagtccgtagagtaactacgaaacgacgttagacggtcgtagacctaccgtaattccgttagttaccttacgtacttaccccg

SEQ ID NO: 4360 - DNA, 535 bp, Homo sapiens
  misc_feature: GYAE6OF02G2DPR.39.31.C09.1.454.CMB.1.raw
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (521)..(521): a, c, t, g, unknown or other
  misc_feature (521)..(521): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctctatttactgggcagtccgtacccggggagtcccggggtccctgaccgtattcgagcggcaggcggtctgagacagtatttcactctcacatcagcagccngcagctagaagntgtgctagtttatattgtcagtctagtattatagtattccctataggttaccgttttggggacccggggtaacaagtcgtaggagtactacgaaacgtactggtagctacgactacattcgtnttcttcacttcccg

SEQ ID NO: 4361 - DNA, 570 bp, Homo sapiens
  misc_feature: GYAE6OF02G0JRC.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacngggctatcgtacccgggagtccggggtcctgaccgattcagcggcgagcggtctgagacagtatttcactctcaaccatcagcagcctgacaggctagaagatgtggctagtttagttacgtcgtacagtacgtagttatttagtacgttagttaccttacgtacgttacgtttcgggacccggggtaaccagtacggtggaacgtacgtacgaaaacgtacgtggtacggtactacggacctaccgtacttcgttacggttccttaccgatttccccg

SEQ ID NO: 4362 - DNA, 576 bp, Homo sapiens
  misc_feature: GYAE6OF02HB2KA.39.31.C09.1.454.CMB.1.raw
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaaccaggacagccctacctaagttgctctatttacgngggcatccgtacccggggagtcccggggtccctgaccgattcaggcggcagcggtctgagacagtatttcacttcctcaccatcagccagcctgcaggctaggaagtatgtggactaagtttattacgtgtacgagactagttattaagtacgttagtcccttagagttaccgttttaggggacccggggaaccgtaagccgttagggaactacgtacgaaacggtaacgttggtacggcgttacgacctactacgtccttgtccttactacttaccccg

SEQ ID NO: 4363 - DNA, 550 bp, Homo sapiens
  misc_feature: GYAE6OF02HZRIP.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcaagaaaccaggacagcctacctaagttgctcatttactggcatccgtacccgggagtcccggggtccctgaccgtattcagccggcaggccgggtctgagacagtactttcgacttctacaccatcagcagcctgcaggctagaagagtgtgctagtttacttactgtcgagctagtattatagttagtacctactagtaccgtttcgggaccggggtaacacgtcgtaggagtatacgaaacgacgtagtacggcgtacgcgacctatacgttcgttacttacgtacttcccg

SEQ ID NO: 4364 - DNA, 586 bp, Homo sapiens
  misc_feature: GYAE6OF02IBIZM.39.31.C09.1.454.CMB.1.raw
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgttttacacaggtaccaaacaataagaattacttcgcttaggtaccagcaagaaaccaggacagcctaccgtaagttgctactatttacnggcatccgtaccgggagtccgggtccngaccgtntcagcgcagcgggtactgagacagtatttcactcnccaacatcacnctacgctgcgaggctagacgtatggtcgagttagttttattactgtcgatcgtaattattaagttaagtacgttaccgttagtacggttaaccgttttggggacccggggtaaccaggtcgtacggaagtagtaaccggtaaacgtacgttaggtcggtacgtcgcctaacctagttccgttagttccttacgtacgttccccg

SEQ ID NO: 4365 - DNA, 507 bp, Homo sapiens
  misc_feature: GYAE6OF02G535P.39.31.C09.1.454.CMB.1.raw
  modified_base (389)..(389): a, c, t, g, unknown or other
  misc_feature (389)..(389): n is a, c, g, or t
tcagtcgcactagtcacgaccggtgctcgatttagacgtctcatcaaggaaggaaggggcagcaagatggtgttgtagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagntgtggctagtttattactgtcagtcagtattatagtagtcctcagtactttggccggggtaccagctggagatacgaacgacgtggtggctgacactatctgtcttctactcttcccg

SEQ ID NO: 4366 - DNA, 775 bp, Homo sapiens
  misc_feature: GYAE6OF02IO9HC.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagcctccctggctgtcgtctcgtgggcgaggacggccaccatccaactgacaagtccagccagtagttgttttacacacggtaccaaacaaataaacgtaattacttcgacgttacggtacccagaccaaacgaaaccgaggaaccacgacccttaccgtaagttcgccttacttacgtttacggtagggacctacgttacccggtaaccccggggtccgggtaccccggggtaccctcggaacccggtacttacgacgggccggaccggtacgggtccgggtacgtacggaacgacgtaacggttacttttcccgaccttactaccgtacctaactccgaacgtcgacgtacccgagtaccgacggtactacgggaactaggttggtacgtacgttaacgttttaacgttccgttacgttacgtacggtactaagtttaagttaacgttggttaacgttcccgtaacgtacggtttacggtttaccggggaacccgggtaaccggtaacgtacggtacggtaacgtaccgtaacggtaaaccggtaccggttcggtacggtaccgttaccgaccctaacggtacctttccgtaccggtttccttaccgttacccttccccgg

SEQ ID NO: 4367 - DNA, 545 bp, Homo sapiens
  misc_feature: GYAE6OF02GOQXW.39.31.C09.1.454.CMB.1.raw
  modified_base (286)..(286): a, c, t, g, unknown or other
  misc_feature (286)..(286): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataaagaattacttcgcttggtaccagcagaaaccaggacagcctcctaagttgctnatttactgggcatcgtacccggagtccgggtcctgaccgattcgagcggcaggcggtctgagacagatttcactctcaccatcagcagcctgcaggctgaagatgtgctaagtttattacgtgtcagactaagtattaatagtagtcctacgagtacgttttcgggccggggaacaacgtcgtaggagactacaaaacggtaacgtaggtcggtacgtcggtaccaccgaacttcgttcgttacttaccgacttccccg

SEQ ID NO: 4368 - DNA, 506 bp, Homo sapiens
  misc_feature: GYAE6OF02F6S63.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcacatcagcagcctgcaggctgaagatgtggctagttattactgtcagcagtatatagtagtctctagtacttttgggaccggggtacaggcgtaggagatacgaaacgaagtacgtggctcgcaccatctgtcttcattcccg

SEQ ID NO: 4369 - DNA, 637 bp, Homo sapiens
  misc_feature: GYAE6OF02HMKFZ.39.31.C09.1.454.CMB.1.raw
  modified_base (285)..(285): a, c, t, g, unknown or other
  misc_feature (285)..(285): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcaagaaaccaggacagcctacctaagttnctctatttactgggctatcgtacccgggagtcccggggtccctgaccgtattccgagccggcgacggcgggtctggagacagtatttcactcacaccatcagcagcctgcaggctagaagtattgtggtactagttttattacgttcgtacagtactaagttataagttagttacgttacccgtacgtaagttaccgggttttcggggacccgggggtaacctaacggtacgttagggtaacgtaacgttaaccgaaaaaccggtaacgttacggtacgggtaccgtacggtacccgaacccgttacggttaccctttacgggtttacccttttaccgtacgtttacccccg

SEQ ID NO: 4370 - DNA, 526 bp, Homo sapiens
  misc_feature: GYAE6OF02IWCPJ.39.31.C09.1.454.CMB.1.raw
  modified_base (371)..(371): a, c, t, g, unknown or other
  misc_feature (371)..(371): n is a, c, g, or t
  modified_base (489)..(489): a, c, t, g, unknown or other
  misc_feature (489)..(489): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaatacttcgcttggtaccagcagaaaccaggacagcctcctaagttgctcatttactgggcatctacccgggagtccggggtccctgaccgattcagcggcagcggtctgagacagatttcactctacaccatcancagcctgcaggctagaagagtgtggctagtttacttatgtcagctagtattatagtagtcctactagtactttgggacccggggtacaagtcgtagagactacgaaacgtaacgttgnggtactcgacgtaccatccgtagtcttacacttcccg

SEQ ID NO: 4371 - DNA, 566 bp, Homo sapiens
  misc_feature: GYAE6OF02HEY9T.39.31.C09.1.454.CMB.1.raw
  modified_base (290)..(290): a, c, t, g, unknown or other
  misc_feature (290)..(290): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagatgtttacacaggtaccaacaataagaattacttcgcttggtaccagcagaaaccaggacagcctcctaagtgctcatttacnggcatctacccgggagtccggggtcctgaccattcagcggcagcggtctgagacagtatttcactctcaccagtcagcagcctgccaggctagaacgnttcgnggtactagttttactacgttgtcgagctaacgtattacgtagttacgtaccctagtagttaccgttttacgggacccggggtaacctaaggtaccgtgggaacgtacgttaacgaaacggtaacgtcggtaggcgtcgactaccgtatccttaggtcccttacacgttacccg

SEQ ID NO: 4372 - DNA, 699 bp, Homo sapiens
  misc_feature: GYAE6OF02JUHQV.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaagggcgagcaagatggtgttgcagacccaggtcttcatttctctgttgctctggatctctggtgcctacgggacatcgtgatgaccagtctccagactccctggctgtgtctctgggcgagaggccaccatcaactgcaagtccagccagagttgtttacacaggtaccaacaataagaattactcgcttggtaccagcagaaaccaggacagcctcctaagttcgctctaatttaacncgggtacagtccgtacccgggtaggtcccggggtccctacggacccgatttaccgagtaccggcaggtcgggtctgagacgagtaactttcacgtctactaccactaccaggactacgtacccgtgtacggacctagtaaaggaacgttggtacggtacgttaacgttttaactttaccgtgtttacccgtaggtacttaaggttaactttaggttaaacgtttcgttacccgttagtaccggtttaaccgttttacgggggtacccgggggttaaaccttaagggaccggtttaagggaccgtagttaccaaacggtaacgttaacgggtagtacctacgggtacctaacccggttaattcccggttagtttacccgttacgttaccttaccccggttaaccccg

SEQ ID NO: 4373 - DNA, 533 bp, Homo sapiens
  misc_feature: GYAE6OF02FM6EP.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttacnggcatctacccgggagtccggggtcctgaccgattcagcggcaggcggtctgagacagatttcactctcacatcagcagcctgcagctgaagatgtggctagtttattacttgtcagctagtattatagtagtctcgtagtacgttttcgggaccggggtaccgaagcgtagggagtacgtacgaaacgtaacgtcgtacggtcttacgaccgtacctactccgttcgtcttctattccccg

SEQ ID NO: 4374 - DNA, 507 bp, Homo sapiens
  misc_feature: GYAE6OF02GPEZR.39.31.C09.1.454.CMB.1.raw
  modified_base (501)..(501): a, c, t, g, unknown or other
  misc_feature (501)..(501): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcagcggcagcggtctgagacagatttcactctcacatcagcagcctgcaggctgaagatgtggctagtttatactgtcagcagtattatagtagtcctatagtacgtttcgggaccggggtaccaggcgtaggagatacgaacgtactgtgctgcactactcgtgtcttaccnttcccg

SEQ ID NO: 4375 - DNA, 612 bp, Homo sapiens
  misc_feature: GYAE6OF02I7F73.39.31.C09.1.454.CMB.1.raw
  modified_base (304)..(304): a, c, t, g, unknown or other
  misc_feature (304)..(304): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagtgtttacacaggtaccaacaataagaattacttcgcttggtaaccaggacaagaaaccaggacaggccctaccgtaaagttgctctatttacgngggcaagtcctacccggggagtcccggggtccctaggaccgtattcgaggccggcgtaacgcggggtctggagtacaggtatttcgacttcaccactatccaaggtccaagcctgacgaacggctagaagtatggtcggacttagtttactacgtgtacacggctaagttataagttacgttactaccgtcctaaggttctttcggggaccggggtaacctaggtaccgtaggaagtactacgaaacgtacggtacgttcgggacttacgacccgaccttagtccgtacgttctacctacttaccccg

SEQ ID NO: 4376 - DNA, 628 bp, Homo sapiens
  misc_feature: GYAE6OF02IQW25.39.31.C09.1.454.CMB.1.raw
  modified_base (322)..(322): a, c, t, g, unknown or other
  misc_feature (322)..(322): n is a, c, g, or t
  modified_base (378)..(378): a, c, t, g, unknown or other
  misc_feature (378)..(378): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggcttgtgtctcgtgggcgagacgggccaccatcaactgcaacgtccagcctagcgttgttttaaccacgaggtaccaaactaactaagtaactttacgttcgcgttaggtaccagccaacgaaaccaggacacgcctaccgtaagtcgactctaagtttacgngggtctacgtacccggtaccgggtacgtcccgggtcctacggaccgttcgtaccgnggcggcgtacgggcgtcgaggaacgacgtagttctacgtctactccactntacncgtacacgtcgcgcgacgctaggagacgtggtcgtattaacgtttactggttacgtatagcgttattactagtactacgttcacgtaccgttaggttaccgggacggaacgtagtacggtagtacgtacaacggtaacgttaagtcgtacgcgttagaccgttcgacgttcctacgttaccttacgccgtttaccc

SEQ ID NO: 4377 - DNA, 604 bp, Homo sapiens
  misc_feature: GYAE6OF02FY4O0.39.31.C09.1.454.CMB.1.raw
  modified_base (297)..(297): a, c, t, g, unknown or other
  misc_feature (297)..(297): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttacacaggtaccaaacaataagaattacttcgcttggtaccagcaagaaaccaggacagcctcctaagtgctctatttacgngggcacgtccgtacccgggagtcccggggtcctgaccgtattcgagccggcacggcgggtctggacgacagtactttcacttcacacctatcagcagtcctcgacaggctagaagtagtggtaggtacttagtttacttcgtgtactacgactaagttattagtacgtactccttacgtacgttacggtttacggggacccggggtaaactaacggtcgtagggtaacgtacgtaaccgaaacggtacgtcggtacggtctacggtaccaaccttacgttccgttacgttccgttactaccttcccg

SEQ ID NO: 4378 - DNA, 759 bp, Homo sapiens
  misc_feature: GYAE6OF02JF985.39.31.C09.1.454.CMB.1.raw
  modified_base (297)..(297): a, c, t, g, unknown or other
  misc_feature (297)..(297): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgatccagtctccagacctccctggctgtgtctctgggcgagagggccaccatccaactgcaacgtccagccagagtgtttacactaggtctaacaataagaattacttcgcttggtaccagcaagaaaccgagacagcctacctaagtgctactatttacnggtcactcgtacccgggacgtcccggggtccctaggacccgtattccgacggtccggcgacggccggtactcggaagaccgtacgtaatttccgacttcctaccgaaccctacgtactaaccgccgaacggtcccgttacgaccgtacgggtacccgtaggtaaaccggtaagttacggttacgggtaccgttaagttttaacgtttaacccgtttaggttaaccgtaccggtaccgttaaaggtttaaacgttttaacgttaaacggtttacccgttaacccgtttaccgtaaacggtttaacccgggttttttaccggggaacccgggggttaacccaaacgggtccggttacgggaacgttaacgtaacccggtaaaaccggtaacgttagggtcggtaccgttacgtacccggtaaccgttaccgttacgtttacgggtttaccttaccgttaacccg

SEQ ID NO: 4379 - DNA, 591 bp, Homo sapiens
  misc_feature: GYAE6OF02HPBLV.39.31.C09.1.454.CMB.1.raw
  modified_base (299)..(299): a, c, t, g, unknown or other
  misc_feature (299)..(299): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgttttacacaggtaccaaacaaataaagaattacttcgcttggtaccagcaagaaaccaggacacgcctacctaagttgctctatttacngggcatcgtacccgggagtcccgggtcctgaccgattcagcggacaggcggtctgagacagtatttcactctcaccatcagcacgcctgacgaggctagaagtatggtaggtactaagttttatactgtacagtctaagttacttagtagtacgttacctacgtacgttacggtttcgggacccgggggtaactaaggtcgtaggaagtacttaaccggaaacgttaacgtcggttaggccgttacggacctaaccgtacttaccgttcgtttaccttcctaccgttccccg

SEQ ID NO: 4380 - DNA, 597 bp, Homo sapiens
  misc_feature: GYAE6OF02G8P4C.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttgtaccagcagaaaccaggacagcctcctaagttgctctatttactggcatccgtacccgggagtccgggtcctggaccgattcagcgcgagcggtctgagacagtatttcactctacaccactcagcacgctgcaggtctagaagtagtggtgtacgtagttttatacttgtacagtactaagttattagttaacgttacgtaccgttacgtaacggttaccggtttttacggggacccgggggtaactacggtaacgttagggtaacgtacgttaaccgtaaaacggtacgttacgaggggtcctacggaccaccgtaacttccgttagttccttacgtaccgttccccg

SEQ ID NO: 4381 - DNA, 585 bp, Homo sapiens
  misc_feature: GYAE6OF02F3UWF.39.31.C09.1.454.CMB.1.raw
  modified_base (304)..(304): a, c, t, g, unknown or other
  misc_feature (304)..(304): n is a, c, g, or t
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagttgttttacactaggtaccaaacaataagtaattaacttcgcttaggtaccagcacgaaaccaggacagcctcctaagtgcctctatttacgngggcagtccgtacccgggacggtcccggggtcctggaccgattcgagcggcaggcggtctgagacagtactttcactctcaccatcagcacgccgtgacgaggctggaagtacgtggtcgacgtagtttattacgtgtcagtacagtttattagtagttcgtacctacgtacgttacggtttcgggaccggggtaccaaggtcgtagtagactacgaaacgtacgtaggtacggtacctcgaccgtaaccgtgttactcggtacttacgtaccttccccgg

SEQ ID NO: 4382 - DNA, 617 bp, Homo sapiens
  misc_feature: GYAE6OF02FNX1X.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttactgggcatccgtacccgggagtccggggtccctgaccgattcagcgcagcgggtctgacgacagtatttcactctacaccactcagcagtcctcgcaggctaggaagatgtgggactaggtttaattacgttgtacgtagctagttaactttattaagttacgttacctacgtacgtaccgtttttacggggacccgggggtaaccgtaacggacgttagggacgtacgtaaccgtaaaaccggtaaacgttacgggttacgggtaccgttcggacccgtaaccgtaacgttccgtttacggttacccgtttacctacgtttcccccg

SEQ ID NO: 4383 - DNA, 560 bp, Homo sapiens
  misc_feature: GYAE6OF02JCIR4.39.31.C09.1.454.CMB.1.raw
  modified_base (298)..(298): a, c, t, g, unknown or other
  misc_feature (298)..(298): n is a, c, g, or t
  modified_base (357)..(357): a, c, t, g, unknown or other
  misc_feature (357)..(357): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttaggtaccagcagaaaccaggacagcctacctaagttcgctcaatttacgnggcatcgtaacccgggagtcccgggtcctgaccgattcagcggcaggtcggtctagganacgagtactttcactctacaccatcagcacgtctgcaggctagaagtagtgtggactagtttattactgtacagtactagttatagtagtacgttacctacgtagttaccgtttacggggcccggggtaactaacggtacgtggacgactaacgaaacgtacgtagtcggactgacaccgtatccgttctcttactactcccg

SEQ ID NO: 4384 - DNA, 579 bp, Homo sapiens
  misc_feature: GYAE6OF02IOZ3V.39.31.C09.1.454.CMB.1.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcaagaaccaggacagcctctaagtgctctattcgnggcatccgtaccggagtcccggtcctagacctatcacgtcggcaggcggtctaggacgacagtactttcacgtcctcgacatcgagcgagtctacgcgacgtctaggaatagtcggtgacttagtttactactcgtacagtctaagttattaacttagtacgttcctacgttacgttcggtttacgggaccgggtacaaggtcgtaggtacacgttaacgtaaacggtaacgtggtacggtacttacggacctaactaacgttcttacgtcttaccgtacgttaccccg

SEQ ID NO: 4385 - DNA, 736 bp, Homo sapiens
  misc_feature: GYAE6OF02HEOD1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaataagaattacttcgcttggtaccagcaagaaaccaggacagccctactaagttcgctactatttacgtgggctacgtccgtaacccggggacgtcccgggggtcccctggacccgtattccgacggccggacgacggccggggtactggaacgacgtaaggtacttttacgaacgttcctaccgaacccacttccgaacgtccgaacggtcccgttacggcccgtaacgggtaccgttacggaaaaggtacgttgggtacgggtacgtttaaacggttttaactttaacggttacgttaccgtaacggtaccgtaaagtttaacgtttaaagttacggttaacggttacccgttataacgggtttaccggtttttaccgggggacccggggtaaaccgtaacggtcggttagggaacgtacgtaacggaaaccggtaacgtagggtacgtcgtacgtaccgtaaccgtacgttccgttacggtttaccttacgtactttccccg

SEQ ID NO: 4386 - DNA, 762 bp, Homo sapiens
  misc_feature: GYAE6OF02JWFRR.39.31.C09.1.454.CMB.1.raw
  modified_base (193)..(193): a, c, t, g, unknown or other
  misc_feature (193)..(193): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacgggacatcgtgatgacccagtcctccagacctcctggctgtgtctctggcgagagggccacatcaactncaagtcacgccagacgtgttttaccacacggttaccaaacaaattaagaattaacctcgtcttaggtaccagacacgaaaaccaggacacgcctacctaagttcgctactattaacgtggtacactacgacccgggtacgtcccggggtcccctagtaccgaacttcgcggtacggaccgacgggtcgggtacctggaacgaccgtaaggtattttaccgaacttccgtacctaacccgattaccgacgcctaacggcccgttacgcccgagggttcagggttaaacgaaccgttgggtagggaccctttaaggttttactttaaccgtcggttacgacgtaacgttaaaccggtttattttaaaggtaacgttacggtttccccaaacggttttaacgttaacccggtttttcgggggggttaaccccggggaaaccttaagggtaccgttaggggtaaacgtaccgtttacccgaaaaagggttccctagggtttaacggccgttaacctaccggtaaacccgttgttaccgtaacccggttttactcccttaaaccggttcccccg

SEQ ID NO: 4387 - DNA, 627 bp, Homo sapiens
  misc_feature: GYAE6OF02GIIUG.39.31.C09.1.454.CMB.1.raw
  modified_base (308)..(308): a, c, t, g, unknown or other
  misc_feature (308)..(308): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccagagttgttttacacgaggtaccaaacaaataagaattacgttcgcttggtaccagacaagaaaccaggacagcctacctaagttcgctctactttacgngggcacgtccgtacccgggaggtcccggggtccctggaccgtattcgacggcggacagggtcgggtctaggaacgacagtattttcgacttccgtacaccactcaacggccaacgcctgacgaggtcgaagaagtagtgtacggtacttaagtttacttacgtgtacgagtctaagttattaagtacgttagtccgtacgtagttaccgtttcggggaccgggtaactaggtcgtagacgtacgtaacgtaaacggtacgtaggtacggtcgttacgactaaccgtagttccgttacgttccttacgactttaccccgg

SEQ ID NO: 4388 - DNA, 668 bp, Homo sapiens
  misc_feature: GYAE6OF02GO8SD.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagtgctctatttacgnggcatccgtacccgggacgtccgggtccctgaccgattcgagcggcagcgggtctgacgacagtacgtttcactctacaccatcgacgccacgccttgaccgtaaggccgttagaaacgtacgttgggtacggtaccgtttaagttttaacgttaaccgttagtacccgtaaggtacccttaaaggtttaattttaacggtaacggtttaccgttacccgttaacgtaacggttttaacggtttttcgggggaacccgggggtaaccctaaaggttacgttagggtacggtaattacccgaaaacggtacgttacggtacgggtcctacggtaccgaaccttacgtccgttacgtttcttacctactttacccccg

SEQ ID NO: 4389 - DNA, 629 bp, Homo sapiens
  misc_feature: GYAE6OF02ITLW3.39.31.C09.1.454.CMB.1.raw
  modified_base (296)..(296): a, c, t, g, unknown or other
  misc_feature (296)..(296): n is a, c, g, or t
  modified_base (345)..(345): a, c, t, g, unknown or other
  misc_feature (345)..(345): n is a, c, g, or t
  modified_base (404)..(404): a, c, t, g, unknown or other
  misc_feature (404)..(404): n is a, c, g, or t
  modified_base (428)..(428): a, c, t, g, unknown or other
  misc_feature (428)..(428): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaataagaattacttcgcttggtaccagacagaaaccaggacagcctcctaagttgctcatttacgngggcatcgtacccggggagtcccggggtccctgaccgtattcgagcggnagcgggtctgagacagtatttcactctccaccatcacgcacgcctgcgaggactgaagngtgtggtactagtttattacgttntacgagtacgtaacgttaatttaagttaagttacgttacccttacgtaggttaccgttttcggggacccggggggttaacccgaaacggtaccgttaggggaagtacgtaaccgaaaaccggtacggttacgggttcggtaccgtacggtaccctaacccgtacttccgttacggttacctttaccgtaccgtttaccccg

SEQ ID NO: 4390 - DNA, 594 bp, Homo sapiens
  misc_feature: GYAE6OF02IZZUK.39.31.C09.1.454.CMB.1.raw
  modified_base (309)..(309): a, c, t, g, unknown or other
  misc_feature (309)..(309): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaaactgacaagtccagaccagagttgttttaacacaggtaccaaactaaataaagaattacttcgacttggtaccagcaagaaaccaggacagcctactaagttgactctaatttacgnggacagtaccgtacccgggtacgtcccggggtcctgaccgtattcgacgcggcaggcgggtctggagacagtatttcactctacaacatcagcagtccngcagctaganagtgtcgactaattacttatgtacagtctaagttacttaatagtaacgttccgtagtacgttacgtttaccggggaccggggtaacaaggtcgtaggaacgtacgtaaccaaacggtcgtaggtacggtctacgacctacgttactaccgttacggtaccttacgtaccgttcccg

SEQ ID NO: 4391 - DNA, 585 bp, Homo sapiens
  misc_feature: GYAE6OF02HW1YG.39.31.C09.1.454.CMB.1.raw
  modified_base (310)..(310): a, c, t, g, unknown or other
  misc_feature (310)..(310): n is a, c, g, or t
  modified_base (418)..(418): a, c, t, g, unknown or other
  misc_feature (418)..(418): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttcgtttaacacaggtaccaaacaaataaagtaattacttcgtcttggtaccagcaagaaaccaggacacgcctacctaagttgcttactaatttacgngggtctacgtccgtacccggggaccgtcccggggtccctacgacccgtattcgagcggcacgggtcggtctggaagcgtagtactttcacgtctacaccagtcagccncgtccgtcgcgagtctagaagtgtgtggtcttagtttatctgtcagacgtatattaagtacgttacgtacctagtagttaccgttcgggaccggggtaacagcgtaggactatacgaaacgtgtcggtggctcgacctacgtcgttcctacggttcttcacttcccg

SEQ ID NO: 4392 - DNA, 535 bp, Homo sapiens
  misc_feature: GYAE6OF02FVP5N.39.31.C09.1.454.CMB.1.raw
  modified_base (290)..(290): a, c, t, g, unknown or other
  misc_feature (290)..(290): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (415)..(415): a, c, t, g, unknown or other
  misc_feature (415)..(415): n is a, c, g, or t
  modified_base (438)..(438): a, c, t, g, unknown or other
  misc_feature (438)..(438): n is a, c, g, or t
  modified_base (525)..(525): a, c, t, g, unknown or other
  misc_feature (525)..(525): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggaccagcagaaaccaggacagcctctaagttgctcatttacngggcatccgtacccgggagtccggggtaccctggaccgattcagcggcaggcgggtctgagacagtatttcactctacaccatcagcagcctgcaggcnggaagntgtgactagtttatacgttntcgagcagttatatagtagtctnagttacgtttcgggaccgggacaggtctggatactagaacgtaacgttgtcggtctacggccaaccgtactccgttcgtaccttccngtttaccccg

SEQ ID NO: 4393 - DNA, 563 bp, Homo sapiens
  misc_feature: GYAE6OF02GFQ2F.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgtttacacaggtccaaacaataagaattacttcgcttggtaccagcagaaaccaggacagcctcctaagttgctcatttactgggcatcctacccgggagtcccggggtcctcgaccgattcgagcggcaggccgggtctgagacagtatttcactctcaccatcagcagcctgcaggctagaagatgtggtctagtttattacttgtcagcgagttattagttagtacgtctcgtagttacgttttcgggaccgggggtaacctaaggcgtgggaagtacgtaacgaaacggtaacgtagtcgggtacgtcgaccgtacgtacttccgttgttacctttactaccgttccccg

SEQ ID NO: 4394 - DNA, 579 bp, Homo sapiens
  misc_feature: GYAE6OF02F2PMM.39.31.C09.1.454.CMB.1.raw
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaacaataagaattacttcgcttggtaccagcaagaaaccaggacagcctactaagttgctctatttactgggcatccgtacccgggaggtcccggggtccctgaccgattcgagcggcaggccgggtctaggagacagtactttcactcacaccatcancagcctgacngcagaantgngctagtttattactgtcagtctagttattagtagttacgtcctagtagttacggttttcggggacccggggtaaccaacggtcgtagggacgtactaaccgaaacggtaacgttcgggtacggtcgtacggaccaccgttagttccgtacgtttccgttacgtaccctttccccg

SEQ ID NO: 4395 - DNA, 548 bp, Homo sapiens
  misc_feature: GYAE6OF02HTCCT.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaaagtccagccagagtgttttacacaggtccaacaataagaattacttcgcttggtaccagcagaaaccaggacagcctctaagttgctctatttactgggcatccgtacccggggagtcccggggtccctgaccgattcgagcggcagcgggtctggagacagtatttcactcctcaccatcagcacgcctgcgacggctagaagtatggtcgacttagtttattacgtgtcagactagttattagtagttacgtcctacgtagtacgtttagggccgggtacagcgtgagactacgaaacgtacgtggtacggcgtgaccgtactatccgttcgttacttccgacttcccg

SEQ ID NO: 4396 - DNA, 634 bp, Homo sapiens
  misc_feature: GYAE6OF02F2S8S.39.31.C09.1.454.CMB.1.raw
  modified_base (334)..(334): a, c, t, g, unknown or other
  misc_feature (334)..(334): n is a, c, g, or t
  modified_base (397)..(397): a, c, t, g, unknown or other
  misc_feature (397)..(397): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacactacggtaccaacaataagaattacttcgcttggtaccagcagaaaccaggacagcctcctaagttgctctatttacgtgggcagtccgtacccgggagtccggggtccctgaccgnttcgagcgcgacgcggtctgacgacagtatttcactctcacatcagcagctgcagcagaagtntggtgctagtttattagtgtcatacgtaagttatttagtaacgttagttacccgttacgtaaccggttacggtttttacgggggaccccgggggtaacctaaacgggtccgttaacggggaagtaccgtaacctaaaacccgggtaacggttcggttacgggtccgttaacggtaccccgtaaccggtactttacccggtttacgtttacccgttttaccacccgttttaccccccg

SEQ ID NO: 4397 - DNA, 660 bp, Homo sapiens
  misc_feature: GYAE6OF02JPKRV.39.31.C09.1.454.CMB.1.raw
tcagtcgcactagtcacgaccggtgctcgatttagacgtctcatcaaggaaggaaggggcgagcaagatggtgttgcagacccaggtcttcatttctctgttgctctggatctctggtgcctacggggacatcgtgatgacccagtctccagactccctggctgtgtctctgggcgagagggccaccgataccaactggcaagtccagccagagttgtttaacacgtacggtccaaacaataagaactttactacgccttcggaaccagtacaacgtaaaccaggaacacgcctacctaaagttcgactactatttacgaggactatccgtaccgggagttcccggggtacctcgaccgattcgacggtcggccaggtccgggtctcggagacgagacttttacgactctaccacgtactcagcacgtcctagccgtagctaaggaactacgtgggtacggcgtaattttagttaaccgtgtacccagtaccgagtttaatagttaagtcgtcttaccgagtttacgtttacgggggaccggtaacccgaggttctacgggagtacctaacggtaaacctacgggttacggtacgggtccacgggttacccaaccgttacgttccggtttaccgtacgtttaccccagtttaacccccgg

SEQ ID NO: 4398 - DNA, 558 bp, Homo sapiens
  misc_feature: GYAE6OF02G8738.39.31.C09.1.454.CMB.1.raw
  modified_base (292)..(292): a, c, t, g, unknown or other
  misc_feature (292)..(292): n is a, c, g, or t
  modified_base (398)..(398): a, c, t, g, unknown or other
  misc_feature (398)..(398): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcctacccgggagtccggggtcctgaccgattcagcggcaggcgggtctgacgacagtatttcactctacaccatcagcagcctgcaggctagaagagtgngtctagtttattactgtcagctaagttattagtagtagttcctcgtagttacgttttacgggacccggggtaaccaaggtccgtagggacgtagtacctaaacggtacgtaggtacggtcgtacgaccacctacgttcgttcgttcttactacttccccg

SEQ ID NO: 4399 - DNA, 577 bp, Homo sapiens
  misc_feature: GYAE6OF02F9RVK.39.31.C09.1.454.CMB.1.raw
  modified_base (295)..(295): a, c, t, g, unknown or other
  misc_feature (295)..(295): n is a, c, g, or t
  modified_base (391)..(391): a, c, t, g, unknown or other
  misc_feature (391)..(391): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttcgctcatttacgngggacatccgtacccgggagtcccggggtcctgaccgtattcagcggcgaggcgggtctgagacagtatttcactctccaccatacagcacgccgngcacggctagaagagttgaggcttagtttacttacgtgtcaagcctaagtactttaagtacgtacgttacctagtacgttacggtttcgggacccggggaaccaggtcgtggaacgacgtacgaaacgtacgtcggtacggtcgtcgaccgtactaggttccttgttccttactaccgtttccccg

SEQ ID NO: 4400 - DNA, 575 bp, Homo sapiens
  misc_feature: GYAE6OF02GM9NR.39.31.C09.1.454.CMB.1.raw
  modified_base (552)..(552): a, c, t, g, unknown or other
  misc_feature (552)..(552): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttacacaggtaccaaacaataagaattacttcgcttggtaccagcagaaaccaggacagcctctaagttgctctatttactgggctatccgtacccgggagtcccggggtccctgaccgattcgagtcgcagcggtctgagacagtatttcactctcaccatcagccagcctgacacggctagaacgatcggtggactagtttattacttgtacgagcgtagtatttaagtagtacgttccttacgagttacgttttacggggaccggggtaacaacggtcgtagggacgtataaccgaaacgtaacgtagtcggtcgtacgaccaccgtattccgtnttaccttaccgtactttaccccg

SEQ ID NO: 4401 - DNA, 561 bp, Homo sapiens
  misc_feature: GYAE6OF02GZN5D.39.31.C09.1.454.CMB.1.raw
  modified_base (293)..(293): a, c, t, g, unknown or other
  misc_feature (293)..(293): n is a, c, g, or t
  modified_base (350)..(350): a, c, t, g, unknown or other
  misc_feature (350)..(350): n is a, c, g, or t
  modified_base (404)..(404): a, c, t, g, unknown or other
  misc_feature (404)..(404): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccagacagcctacctaagttgctctatttacgnggacactccgtacccgggagtccggggtcctggaccgattcgagcggcaggcgggtntgagacagtatttcactctacacctatcacgacacgcctgcaggctagaacgtntagtgactagtttatacttgtctagctaagtaattagtacgtacgttacctacgtagttacgtttagggacccggggaactaggcgtaggagtacgtaacgaaacggtacgtagtcggactaggtaccactagttcctggtcctttacagttccccg

SEQ ID NO: 4402 - DNA, 613 bp, Homo sapiens
  misc_feature: GYAE6OF02GN0AN.39.31.C09.1.454.CMB.1.raw
  modified_base (295)..(295): a, c, t, g, unknown or other
  misc_feature (295)..(295): n is a, c, g, or t
  modified_base (425)..(425): a, c, t, g, unknown or other
  misc_feature (425)..(425): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcaagaaaccaggacagcctcctaagttcgctctatttacngggctactccgtacccgggaggttcccggggtccctggaccgtattcaggccggcaggccgggtcaggagacagtactttcactctaccgaaccataccagccacgcctggacgacggactaggaacgtntggtacgtcttaagttttattacgttgtacgagtacttaagttatttagtacgttacgtcctagtacgttacgtttcggggacccgggtacgtagccgtagggacgtacgtacgtaaacggtacgttggtacggtccgtacgacctaccgtacgtttccgtcgttacgttaccgtactttacccccgg

SEQ ID NO: 4403 - DNA, 768 bp, Homo sapiens
  misc_feature: GYAE6OF02JSUVX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatcgacccagtctccagacctcccgtggctgtgtctcgtgggcgagacggccaccatcaacgtgacaagtccagccagtagttcgtttaacacgaggtaccaaacaagtaaacgtactttaccttcgcttacggtaaccagacaaacgaaaccaggtaacacgtacccttacctaaacgttccgaccctaacgtttacgtcgggacctaccgttacccgtacccgggtacggtacccggggtacccctaggacccgtattccgaacggtccggacgacgggtccggttacgtacggaacgtaacgtacgtaacgttttacaacccgttcttacccaaacccgtattaccgaacgcgtaaccgtccctacggaccgtacgggtacctaagggtaaacgtacggttacggtacggttaacgttaacgttttacgttaacgtacgttacgacggttacgttaagttaacgtttaagtacgttacgttaccgtacgttaaccggttttacgggtaccgggtaccggggtaactaccggtacggtaacggtaacaacgttaacgaaaccggttacgtcggttacgacgtaccgtacctagtaccttacgtatttcccgtacttacctccccgttacccg

SEQ ID NO: 4404 - DNA, 840 bp, Homo sapiens
  misc_feature: GYAE6OF02HI7XR.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgccgtacgggacatcgtgatgacccagtctcagacctccctggctgtgtctcgtgggcgaggacgggccaccatcaactgacaacgtccacgccagtagttgtttaacacgtacggtaccaaacgtaaataagtaacttaaccgttcgtcgtttacggtaaccaaacgaacgaaaaccgacggaacacggtccctaccgttaaaggttcgaccttactaagttttaccggtgggacctaacgttacccggtaacccggggtacgggttcccccggggttaccccgtaccggtaaccgttacggttaccggacgggtaccggacggtacggggtaccgggttacgaacggtaaccggtaacggtaacgtttacctttaccctaaccgttaccgtaacccgtaactacgtaccgacgtaccgtaccgtccgtacgaacggtacggaacgtaagggtacgtaggttcggtaagttacgggtttaacttttaaaccgtcgttacggtaaccgtacgttaacgtttaaatttacggttaacgttaccggttaccccgttaacgttaacggttacgggttttaacccgggggttaccggggaaaccccggtaataaccgggtgtaacgggtaactaaccgtaacggtaaacggtcgtagggacctttcggaaccgtactaacgtttccggttactacgtttacccgttacgtacccgttccccgtaaccg

SEQ ID NO: 4405 - DNA, 625 bp, Homo sapiens
  misc_feature: GYAE6OF02IX9GZ.39.31.C09.1.454.CMB.1.raw
  modified_base (373)..(373): a, c, t, g, unknown or other
  misc_feature (373)..(373): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagacagaaaccaggacagcctacctaagttgctctatttacgtgggcatccgtacccgggaggtcccggggtccctgaccgattcaggcggcaggcggtctgagacagtatttcactcncaccatcacgcagcctgcgacggctagaagtagtggtacgacttagtttattacgtgtacgacgtacgtaagtttaattacgtacggttacgttaccttacgtaacgtttaccggttttcggggacccgggggttaaaccacggtacgtagggtaacgtactaaccggtaaaaccggtaacgttcggtacgggtaccgttacggtaccctaaccgtcgttacccgttagttcccttacgtacctttccccgg

SEQ ID NO: 4406 - DNA, 559 bp, Homo sapiens
  misc_feature: GYAE6OF02G3SUH.39.31.C09.1.454.CMB.1.raw
  modified_base (294)..(294): a, c, t, g, unknown or other
  misc_feature (294)..(294): n is a, c, g, or t
  modified_base (348)..(348): a, c, t, g, unknown or other
  misc_feature (348)..(348): n is a, c, g, or t
  modified_base (505)..(505): a, c, t, g, unknown or other
  misc_feature (505)..(505): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcagaaaccaggacagcctcctaagttgctcatttacgnggcatcctacccgggaggtccgggtccctgtaccgattcagcggcgagcgggtntagagacagtatttcactctacaccatcagcacgcctgacacggctagaagtgtgtacggacttaagttttactacttcgtacgagtacctaagttagttataacgttcgtaccctcgaagttacggtttacggggaccggggtaacagcgtagtanacgtacaaacggtagtgtggactcgacctactactcttagtctccagttccccg

SEQ ID NO: 4407 - DNA, 578 bp, Homo sapiens
  misc_feature: GYAE6OF02F3PRZ.39.31.C09.1.454.CMB.1.raw
  modified_base (297)..(297): a, c, t, g, unknown or other
  misc_feature (297)..(297): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccgatcaactgcaagtccagccagagttgttttacacaggtccaacaataagaattacttcgcttggtaccagcagaaaccaggacagcctacctaagttgctctatttacgngggcatccgtacccgggagtccggggtcctgaccgtacttcgagcggcagtcggttctgagactagtatttccactctacactatcagcacgcctgcgaggctagagtagtcggtgacttagtttacttacgttgtctagtacgtagttactttagtagttacgtccttacgtagttacgtttcgggaccgggtaacacggtcgtagtacgtacgtacgtaaacgtcgttaggtcggtactacgccgtactacgttccgtagttccttacgactttccccg

SEQ ID NO: 4408 - DNA, 545 bp, Homo sapiens
  misc_feature: GYAE6OF02HG522.39.31.C09.1.454.CMB.1.raw
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (405)..(405): a, c, t, g, unknown or other
  misc_feature (405)..(405): n is a, c, g, or t
  modified_base (434)..(434): a, c, t, g, unknown or other
  misc_feature (434)..(434): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtcctgaccgattcaggcggcagcggtctgagacagatttcactctcaccatcagcagcctgcaggctgaagntgngctagtttatactntcagctaagtatagtagttacgtccttanagttacgttttcgggacccgggggtaccaagcgtagggaacgagtacgaaaccggtacgtggtcggtacctagcctaacctacgttctcggttctttccacgtttaccccg

SEQ ID NO: 4409 - DNA, 549 bp, Homo sapiens
  misc_feature: GYAE6OF02HQUX0.39.31.C09.1.454.CMB.1.raw
  modified_base (295)..(295): a, c, t, g, unknown or other
  misc_feature (295)..(295): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcaagaaaccaggacagcctctaagttgctctatttacgngggcagtccgtacccgggagtcccggggtccctgaccgtattcgagccggcaggcgggtctgagacagtatttcactctcaccatcagcacgcctgcaggctagaagatggtgactagtttattacgtgtcagtctaagttattatagttacgtcctagtacgttacgtttcgggaccggggtaaccaggcgtaggagtactacgtaaacgaacgttgtggcgtcgactaccatccgttgtcttctacttcccg

SEQ ID NO: 4410 - DNA, 697 bp, Homo sapiens
  misc_feature: GYAE6OF02IUGAT.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggacggccaccatacaactgacacgtccagccagtagttcgtttaacacgacggtaccaaacaataagtaacttacttcgtacgttaggtaccagacaacgaaaccaggaacacgtaccctaccttaagttcgctctacgtttacgtcgggactacgtaccggtaacccggggtacggttccccggggtccctacggacccgtacgttcgacggccggacgacgggtccggtacgtacggaacgacgtaacgttactttacccgacttccgttaccaaccgtactaccgtacgaccgtacgtccgtacggaccgtacggtacgaggtaaaggtcgttagggtaccgtacgtttaagttttacgtacgttgtacgagtacgtaattatacgttacgtcgttctacgtacgttcggttcggggaaccgggtacaggtacgtagggtaactactaccgtaagacggttgtacggtcgtacgcctaaccgttctccggttcttaccgttacctcgttaccccg

SEQ ID NO: 4411 - DNA, 547 bp, Homo sapiens
  misc_feature: GYAE6OF02HPQ8N.39.31.C09.1.454.CMB.1.raw
  modified_base (291)..(291): a, c, t, g, unknown or other
  misc_feature (291)..(291): n is a, c, g, or t
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacngggcatctacccgggagtccggggtccctgaccgattcgagtcggacaggcgggtctgagacagntttcactctcaccatcancagcctgcaggctgaagatggtgtctagtttattactgtcagnattatattagtagtccttnaagttcgtttgggaccgggtaccgtaagcgtaggagacgtacgtaaaccggaacgtcggtggcgtacgaccgtaccacgtaccgttcgttaccgtttctaccgttaccccg

SEQ ID NO: 4412 - DNA, 712 bp, Homo sapiens
  misc_feature: GYAE6OF02H8E64.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtcctccagacctccctggctgtgtctcgtgggcgaggacgggccaccatccaactgacaacgtccagccagagttgtttacacaggtaccaaacaataagtaattacttcgtacttcggtaccaagcaacgaaaaccgaggacacgacctactaagttgacttctatttacgtgggctacgtccgtacccggggacggttccccggggtccctacggaccgtagttaccgacggtcggacgacggtcgggtactgggtaacgacgtaagtactttcaacgttcctccaacctataccgtacgccgtacgtcccgttcggaccgtacggtaccgtagaaacggtagttagggacggtactttaagtttttacgtacgttcggtactagtacgttaagttaagttaacttaggtttaccgtaccttcgacgtttacggttttaccgggaccgggggtaacaaggtccgtagggtaccgtagttaaccgaaaccgggtagttacgggtcggtaccgttacgacccgtaaccttacgtcgttacgtttacccgtttaccacctttacccccgg

SEQ ID NO: 4413 - DNA, 592 bp, Homo sapiens
  misc_feature: GYAE6OF02GREBX.39.31.C09.1.454.CMB.1.raw
  modified_base (244)..(244): a, c, t, g, unknown or other
  misc_feature (244)..(244): n is a, c, g, or t
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (358)..(358): a, c, t, g, unknown or other
  misc_feature (358)..(358): n is a, c, g, or t
  modified_base (392)..(392): a, c, t, g, unknown or other
  misc_feature (392)..(392): n is a, c, g, or t
  modified_base (418)..(418): a, c, t, g, unknown or other
  misc_feature (418)..(418): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcncttggtaccagcagaaaccaggacagcctcctaagtgctcatttacgnggcatccgtacccgggagtccgggtccngaccgattcagcgcaggcggtctgagacagtatttacnctctcacatcagccagtcctgcaggctagaacgntgtggactagttttactacgttctanagtactagttaatttagtacgttacgtacccgttagtaacggtttacgttttacgggggaccgggttaaccaaaggttccggtagggaacgtacgtaacgtaaaacggaacgttacggtacgggtaccttgaacccacgtaacttccgttaggtttccttactacgtttccccg

SEQ ID NO: 4414 - DNA, 621 bp, Homo sapiens
  misc_feature: GYAE6OF02GYEID.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttcgcttggtaccagcaagaaaccaggacagcctctaagttgctctatttacgtgggcatccgtacccgggaggtcccggggtccctggaccgattcaggcggacgacggcgggtctgagacagactttcactctacacatcagtcagcctgcaggtctagaagtatggtcggacttagtttattacgtgtacgagtcgaagttacttagttacgttaacgttcctacgtaacgtttaccggttttcggggacccgggggtaaccaacggtcgttagggtaacgtactaaccgtaaaacggtaccgttagggtacggtacgttacgacccttaaccgtacgttaccgtttacggttccctttactacccggtttaccccg

SEQ ID NO: 4415 - DNA, 632 bp, Homo sapiens
  misc_feature: GYAE6OF02HM87Q.39.31.C09.1.454.CMB.1.raw
  modified_base (301)..(301): a, c, t, g, unknown or other
  misc_feature (301)..(301): n is a, c, g, or t
  modified_base (392)..(392): a, c, t, g, unknown or other
  misc_feature (392)..(392): n is a, c, g, or t
  modified_base (446)..(446): a, c, t, g, unknown or other
  misc_feature (446)..(446): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtcctccagacctccctggctgtgtctcgtgggcgagaggccaccatcaactgcaagtccagccagagttgttttacacaggtaccaacaataagaattacttcgcttaggaccagcaagaaaccaggacacgcctactaagttgctactatttacgngggctacgtaccgtaacccggggtacggtccccggggtccctggaacccgtattccgaggccggacacgggtcgggtacctggacgaaccnggtactttccgactctcaaccatcacgcagtcccgtgacgaggcctagaaacgngtcgtggtactaagttttatacgttcgtactacgtactaagttaacttagttaagttacgttaccgtacgtacgttacggtttacggggacccgggggtaacctaaggcgttaggagtacgtaaccgaacggtaacgtggttacggtactcgacacgtactccgtagtttacctactacttccccg

SEQ ID NO: 4416 - DNA, 545 bp, Homo sapiens
  misc_feature: GYAE6OF02IG4T7.39.31.C09.1.454.CMB.1.raw
  modified_base (295)..(295): a, c, t, g, unknown or other
  misc_feature (295)..(295): n is a, c, g, or t
  modified_base (381)..(381): a, c, t, g, unknown or other
  misc_feature (381)..(381): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctctaagttcgctctatttacgngggacatccgtacccgggaggtcccgggtcctgaccgtattcgacgcggcaggcggtctgacgacagtatttcgactctcacatcngcagcctgcaggctagaagntgngcttagtttatatgtcagtctaagttntaangttactctacgtagttacgtttcggggacccgggaactaggtcgtaggagtacgacgtaaacggtacgtggtacgctagacctacgcttctcggtacttctaccttcccg

SEQ ID NO: 4417 - DNA, 718 bp, Homo sapiens
  misc_feature: GYAE6OF02IW8G3.39.31.C09.1.454.CMB.1.raw
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtcccagccagtagttgttttacacgtaggtaccaaacaataagtaattacttcgacttcggtaccagacagaaaccaggacacgtcctaccgtaagttcncttactacgttttaacgnggggtcaagtccggtacccggggacggttcccggggtacccctggaacccgtattccgaggccggcgaggcgggtctggacgacagtactttcaccttcgaccaacctacgtcacgtccgacgtccgtcgtacgacggacgtagtaagtcgttaggtcggtacgttaaggttttacttacgttagtccgtaagtcttaaggttatttaggtaacgttcgttaccttacgtaacggtttacggtttaccgggggacccggggtaaccgacgtacggttagggaaccgtaccgttaacgaaaccgggttaacgttgggtaccggtaccgtaccgggtaacccttacccggtaacgtttccccgggttaacgtttcccttttacccggtacttttcccccccgg

SEQ ID NO: 4418 - DNA, 538 bp, Homo sapiens
  misc_feature: GYAE6OF02FXUFL.39.31.C09.1.454.CMB.1.raw
  modified_base (483)..(483): a, c, t, g, unknown or other
  misc_feature (483)..(483): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagttgctcattactgggcatcgtacccgggagtccggggtccctgaccgattcagcggcaggcgggtctgagacagtatttcactctcaccatcagcagcctgcaggctgaagtactggtcggctaagtttattacgtgttcagctagtacttatagtacgtctagacgttacgtttcgggaccggggaaccaaggtcgtacgggtanactacgaaacgtacgtggtgtctcggccaacgtctccgtgtccttcacttacccg

SEQ ID NO: 4419 - DNA, 586 bp, Homo sapiens
  misc_feature: GYAE6OF02G8W7A.39.31.C09.1.454.CMB.1.raw
  modified_base (227)..(227): a, c, t, g, unknown or other
  misc_feature (227)..(227): n is a, c, g, or t
  modified_base (292)..(292): a, c, t, g, unknown or other
  misc_feature (292)..(292): n is a, c, g, or t
  modified_base (413)..(413): a, c, t, g, unknown or other
  misc_feature (413)..(413): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaanaataagaattacttcgcttggtaccagcagaaaccaggacagcctcctaagttgctcatttacgngggcatccgtacccggggagtcccggggtcccctggacccgtattcaggccggcaggcgggtctggacgacagtattttcacttctaccacctatcagccacgccgtgcgaggctagaagnttggtggtactagtttattacgttgtcagtctaagttattagtagttacgttcctagtacgttaccgttttacggggacccgggggtaaccaaggtcgtagggagtacgtaacgaaaccgtaacgtggtacggcctcgacctacctacttcgttcgttccttctacttccccg

SEQ ID NO: 4420 - DNA, 693 bp, Homo sapiens
  misc_feature: GYAE6OF02JWH7N.39.31.C09.1.454.CMB.1.raw
  modified_base (347)..(347): a, c, t, g, unknown or other
  misc_feature (347)..(347): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagctccctggctgtgtctctgggcgagaggccacatcaactgcaagtccagccagagttgttttaacacgacggtaccaaacaaataagtaattacttcgtacttggtaccagaccaagaaaaccgaggacagccttacctaagttgacttctatttacgtcggcactccgtacccggggtacgtcccggggtacccnggtacccgattcgacgtcggcacggtcggtctaggacgtacgagtactttacacctctaccaacctagtacacgaccgacgtcgtcgacgaggccttaaggaacgtacgttgtacgggtacttaggttttattaacgtgtacgaggtacctagtttaattacgttaaacggttcgttacctacgttaacgggtttaccgggttttaccgggggaacccggggtaaccctaagggtcccgttagggtaacctaccgggttaaactaaacccgggtagttacggtacgtaccgttcggaaccgtttacggtactccggtttacgtttacgttaccgtcccttacccgg

SEQ ID NO: 4421 - DNA, 850 bp, Homo sapiens
  misc_feature: GYAE6OF02HB01U.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaacgtccagccagtagttcgtttacacgacggtaccaaacaaattaaagtaattaccttacgcttggacaccagacaacgaaaccaggacacgcctaccgtaagtcgctactactttacgtcggactacgtaccgtacccggggtacgttccccggggtaccctacggacccgtagttaccgaacgggtccgggaccgacgggtaccggggtccgtacggaacggtaaccgtaacgttacgtttaccctaccttacctacccgtaaccctaacgttaccgaaccgaccgtaaccggtccccgtacggaccggaacgggtaccgttaaacggaaaagggttcgttacggggtacgggttacctttaaacgggtttttaaccgttacgttaccggttacgtaacgtaacgttaaaggtttaagtttaagttaaccgggttacgtttaacccgttacggttaaccggttttaaccggggttttaccggggggaaccccgggggttaacctaaaccggggttacggtaacggggtaacgttaaccggtaaacccggtaaaacgggttaaccggttacgggtaccgggttacccttacgggtaaccctaaccggttactttaccggtttaccgtttacccgttacccgttaaccccg

SEQ ID NO: 4422 - DNA, 568 bp, Homo sapiens
  misc_feature: GYAE6OF02GPTOD.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaacaataagaattacttcgcttggtaccagcaagaaaccaggacagcctacctaagttgctactatttacgtgggctatccgtacccgggagtcccggggtccctgaccgattcagcggacaggtcggtctgagacagtatttcactctcaccatcagcagcctgcgaggctagaagagtgtggactagtttattacttgtacgtagacgtaagttattaatagtacgtactactagtacgtttcgggaccggggtacaagtcgtaggagtacgtacgtaaacgtaagttacggtggtcgtacgacacctacgttccgttcgttaccgttactaccttacccg

SEQ ID NO: 4423 - DNA, 545 bp, Homo sapiens
  misc_feature: GYAE6OF02GHQ1K.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaccaggacagcctctaagttgctcatttactgggcatcgtacccgggaggtccggggtcctgaccgattcagcggcaggcggtctgagacagtatttcactctcacatcagcagcctgcagactagaagatgtgtctagtttacttacgttgtcagctagttattatagtagtcctcgtagttacgtttcgggaccggggtaacagtcgtaggagtacgtacgaaacgtaacgtaggtcggtacgtacgacgtaccgtacttccgttacgtcgttactacttcccg

SEQ ID NO: 4424 - DNA, 538 bp, Homo sapiens
  misc_feature: GYAE6OF02GBDX1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatcgtacccgggagtccggggtcctgaccgattcagcggcaggcggtctgagacagatttcactctcaccatcagcagcctgcaggctagaagatgtggctagtttattactgtcagctagtattatagttacgtcctcgagtacgttttcgggaccggggtacaacggcgtagggagtagtacgaaacggtaacgtaggtcggcgtacgccacctacgttccttcgttcttactacttcccg

SEQ ID NO: 4425 - DNA, 560 bp, Homo sapiens
  misc_feature: GYAE6OF02FSIDC.39.31.C09.1.454.CMB.1.raw
  modified_base (291)..(291): a, c, t, g, unknown or other
  misc_feature (291)..(291): n is a, c, g, or t
  modified_base (359)..(359): a, c, t, g, unknown or other
  misc_feature (359)..(359): n is a, c, g, or t
  modified_base (388)..(388): a, c, t, g, unknown or other
  misc_feature (388)..(388): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacnggcatctacccgggagtccgggtcctgaccgtattcagcgcaggcggtctgagacagtatttcactcncacatcagcagcctgcagctagaagatgngctagtttattactgtcagctagttattagtagttacgtacctcgtagttaacgtttcgggacccggggtaacaacggtcgtagggacgtacgttaccgaaaacggtacgttggtacggtccttacggaccgtaacctacgttccgttgttacctttccgacgtttcccccg

SEQ ID NO: 4426 - DNA, 574 bp, Homo sapiens
  misc_feature: GYAE6OF02ID0A8.39.31.C09.1.454.CMB.1.raw
  modified_base (417)..(417): a, c, t, g, unknown or other
  misc_feature (417)..(417): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaacaataagaattactcgcttggtaccagcagaaaccaggacagcctctaagttgctctatttactgggcatccgtacccggggaggtcccggggtccctgaccgtattccgagcggacacgggcggtctagacgacagtactttcactctcaccatcagcacgctgcagctagaagatgtcgctagtttntactgtcagatagtattagtagtagttacctagtacgttacggttttacgggacccggggtaacaaggcgttaggacgtactacgaaaccgtacgtcggtacggtcgtacgacccgtaccgtacgttccgttcgttaccgttacctactttaccccg

SEQ ID NO: 4427 - DNA, 564 bp, Homo sapiens
  misc_feature: GYAE6OF02GPKK5.39.31.C09.1.454.CMB.1.raw
  modified_base (293)..(293): a, c, t, g, unknown or other
  misc_feature (293)..(293): n is a, c, g, or t
  modified_base (395)..(396): a, c, t, g, unknown or other
  misc_feature (395)..(396): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccaaagtctccagactccctggctgtgtctctgggcgagagggccaccatcaactgcaagtccagccagagttgtttacacaggtccaaacaataagaattactcgcttggtaccagcagaaaccaggacagcctctaagttgctcatttacngggcatccgtacccgggagtccgggtccctggaccattcgagcggcaggcggtctaggagacagtatttcactctacaccatcagcagcctgcaggcagagnngtgctagttatacgtgtacagctagtattagtacgtacgttcctacgttagttacggttttcgggaccgggggaacctaaggcgttagggaacgtgtaaccgtaaacggtacggtacggtggaccttggaccctacgtacttccgttattccgtttacacgttccccg

SEQ ID NO: 4428 - DNA, 586 bp, Homo sapiens
  misc_feature: GYAE6OF02F82K7.39.31.C09.1.454.CMB.1.raw
  modified_base (293)..(293): a, c, t, g, unknown or other
  misc_feature (293)..(293): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (427)..(427): a, c, t, g, unknown or other
  misc_feature (427)..(427): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttacacgaggtaccaacaataagaattacttcgcttggtaccagcagaaaccaggacagcctctaagtgctcatttacgngggctatccgtacccgggaggtcccggggtccctgaccgtattcaggcggcaggccgggtctgagacagtactttcactctcaaccntcngcagtcctgacaggctagaagatgtggactaggtttattacgtntcgaagtctaagttatttaagtacgttacgtaccttagtacgttacggtttcggggccgggtaaccaaggtcgtaggagtactaaccgaaacggtaacgttgtacgggacctacggaccctaacgtacgttacgttcgttaccttcgtactttcccccg

SEQ ID NO: 4429 - DNA, 578 bp, Homo sapiens
  misc_feature: GYAE6OF02HXKJE.39.31.C09.1.454.CMB.1.raw
  modified_base (303)..(303): a, c, t, g, unknown or other
  misc_feature (303)..(303): n is a, c, g, or t
  modified_base (384)..(384): a, c, t, g, unknown or other
  misc_feature (384)..(384): n is a, c, g, or t
  modified_base (414)..(414): a, c, t, g, unknown or other
  misc_feature (414)..(414): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttacgttttacacacggtaccaaacaataagaattacttcgcttggtaccagcaagaaaccaggacagcctacctaagttgctctatttacngggcactcgtacccggggagtcccgggtcctagaccgattcaggcggcaggcgggtactggacgacagtactttcactccncaccatcagcagcctgcgaggctaggaatntggtgacttagtttactactgtcagtctaagttatttaatagttacgtcctagtacgttacgtttcggggacccggggaacaagtcgtaggagtactaacgaaacgtcgtggtacgcgtacgacctacgtacttccgttacgttacctttccgactttcccccg

SEQ ID NO: 4430 - DNA, 628 bp, Homo sapiens
  misc_feature: GYAE6OF02GDOZT.39.31.C09.1.454.CMB.1.raw
  modified_base (302)..(302): a, c, t, g, unknown or other
  misc_feature (302)..(302): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccaggagttgtttacacgaggtaccaacaataagaattactcgtcgttggtaccagcaagaaaccaggacagcctctaagttgactctatttacgngggactagtccgtacccggggacggtcccggggtccctggaccgtattacgacggccggcgacggcgggtcgtaggacgacgtacgtacttttacacttcctacacctactacgacgcacgcctgacaagggtctagaaagtgtaggtagacttagtttattacgtgtacagtcgtaagttactttagtagttcgcttagtacgttacggtttcgggaccggggtaactacggtcgtaggacgtagtaaccgtaaacggtacgttaggtacgcgttacgacccgtacgtacgttaccgttcgttacccttacgtaccgttaccccg

SEQ ID NO: 4431 - DNA, 604 bp, Homo sapiens
  misc_feature: GYAE6OF02F2SYL.39.31.C09.1.454.CMB.1.raw
  modified_base (340)..(340): a, c, t, g, unknown or other
  misc_feature (340)..(340): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaacaaataagaattaccttcgcgttggtaccagcaagaaaccaggacagcctacctaagttgctctatttactgggcagtccgtacccgggacggtccggggtccctggaccgnttcgacggcggcacggcggtctgagacagtatttcactctcacatcagcacgtccgtagccgaggtccgtaggaacgtagtggtacggtacttagtttacttcgtgtcagtacgtagttaattatagtacttcctacgtagtttacggtttaccgggaccggggttaacacggtcgtaggaacgtactaaccgtaaacgtaacggttacggtcggtacctacgaccgtaccgtacgttacgtcgtttcctactccgttaccccg

SEQ ID NO: 4432 - DNA, 557 bp, Homo sapiens
  misc_feature: GYAE6OF02GRC38.39.31.C09.1.454.CMB.1.raw
  modified_base (297)..(297): a, c, t, g, unknown or other
  misc_feature (297)..(297): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttacacaggtaccaaacaataagaattacttcgcttggtaccagcaagaaccaggacagcctcctaagtgctctatttacgnggcagtccgtacccgggaggtccggggtcctgaccgattcaggcggcaggtcggtctgagacagtatttcgactctacaccatcaagcacgcctgcacggtcagaagagtgtcggatacgttagttacgtgtcagtctagtattagtagttacgtctacgtacgttacggtttcgggaccgggaaccaggtacgtggagtactacgtaacgtacgtggtcgctcgacgacgtcgttacgttacgtccttcgtacttcccg

SEQ ID NO: 4433 - DNA, 609 bp, Homo sapiens
  misc_feature: GYAE6OF02IQ1I5.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaacaataagtaattacttcgtcttggtaccagcaagaaaccaggacagcctacctaagttcgctctatttacgtgggcactccgtacccgggagtcccggggtccctcgaccgattcacggcggcacgggcgggtctggacgactagtactttcactctcaccatacacgcacgcctcgtcgacgtcgtaggaagagtggtacggtacgttagtttattacccccgttgtaccgtagactaagtattaagttagttacgttacctacgtagttacgtttacgggtaccggggtaccgtagtacgtaggagtacgtaacgtaacggaacgtacggtacggtcgtacgacgtacctacgttaccgttcgtaccttctacttacccg

SEQ ID NO: 4434 - DNA, 593 bp, Homo sapiens
  misc_feature: GYAE6OF02F1CXV.39.31.C09.1.454.CMB.1.raw
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttacngggcatctacccgggagtccgggtcctgaccgattcagcggcagcgggtctaggacacagatttcgactctcaccatcagcagctgcagctagaagagtgtggctagttacttacgttgtacagactaagtattagtacgttaagtacctacgtaacgtacgttttacggggacccgggggaacctaaggtacctagggtaacgtacgtaaccgaaaaccggtaaccgttaggttacgggacgttacgtaccgacccgtaacgttaccgttacggtttacctttaccgtactttacccccgg

SEQ ID NO: 4435 - DNA, 744 bp, Homo sapiens
  misc_feature: GYAE6OF02GT0FG.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaacgtccagccagacgttgtttacacacggtaccaaacaataaagaattacttcgcttggtaccagacagtaaaccaggacacgcctccgtaagttcgccttactatttacgtcgggacctacgtaccggttaccccggggtaacggttccccggggggttcccctacgggtaacccgttacgtttacccgtacgggacccggggtcgaacggggtccggggttccgtaagggaacggtaaacccgtaggtaaccttttttcccgaaacctttcctaacccaacctaaacttcccgaaggtcccaaccgggtcctacgacgacgggtaccgtaagtaacggagttacggtacgggtacttaacggttttacttacgtcgttacgacgtacctagttattaagttacgtacgtaccttccgtagttaccgttttcgggggacccgggtaacgtaacggcgtaaggtacggactaacgaaacgtaacgtacggtcggtaacgttacgaccctactactcgttacgttccttacctacgtttaccccg

SEQ ID NO: 4436 - DNA, 627 bp, Homo sapiens
  misc_feature: GYAE6OF02IYXEE.39.31.C09.1.454.CMB.1.raw
  modified_base (382)..(382): a, c, t, g, unknown or other
  misc_feature (382)..(382): n is a, c, g, or t
  modified_base (446)..(446): a, c, t, g, unknown or other
  misc_feature (446)..(446): n is a, c, g, or t
  modified_base (479)..(479): a, c, t, g, unknown or other
  misc_feature (479)..(479): n is a, c, g, or t
  modified_base (492)..(492): a, c, t, g, unknown or other
  misc_feature (492)..(492): n is a, c, g, or t
  modified_base (513)..(513): a, c, t, g, unknown or other
  misc_feature (513)..(513): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacgggacgatcgtgatgacccagtctccagacctccctggctgtgtctctgggcgagagggccaccatcaactgacaagtccagccagagtgttttacacgtacgtaccaaacaactaaaggaatttaccttacgccttttaggtaaccctaagtaccaaacgaaaaccgaaggaaccgaacgtacctaccgtaagttcgccttactaacttaccggttcggactacttccgtaacccgggacgtccccggggttacccngtaccgacttcgaggtcgacgagccgggtctaggacacgagtattcacttctacacctactacncgcacgcctacgcgacgcgtagaacgattcggngtaccgtagtttntacttgtacatagagttaatntagttacgtccagtagtacggtttgggtaaccgggactagacgttagggaactagtaaccggaagtaacgtacggttgcctagcctaacctgttacctgttacttcgatacccg

SEQ ID NO: 4437 - DNA, 644 bp, Homo sapiens
  misc_feature: GYAE6OF02HL2EC.39.31.C09.1.454.CMB.1.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagaatttacttcgcttggtaccagcaagaaaccaggacagccctacctaagttcgctctatttacgngggccatccgtaacccgggngtcccggggtccctgaccgtattcgacgcggcacggcggttctagacgacgagtactttaccactctacaccatcacgcacgctgcaggctagaagagttggtacggtacttaagtttattacgttacgtcagtaccgtaagttaattagttagttacgttaccttacgtagttaccggttttacggggacccgggggtaacaacggtacgtggtaacgtacgtaaccggtaaacgtaaccggttaggtaccggtaacgtaccggtaccctaacccgtacggtttccgttaccgtttcctttacgtaacccgtttacccccgg

SEQ ID NO: 4438 - DNA, 626 bp, Homo sapiens
  misc_feature: GYAE6OF02I6ZU0.39.31.C09.1.454.CMB.1.raw
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
  modified_base (616)..(616): a, c, t, g, unknown or other
  misc_feature (616)..(616): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagaggccaccatcaactgcaagtccagccagagtgtttacacaggtccaacaataagaattacttgcttggtaccagcagaaaccaggacagcctacctaagttcgctctatttaccgnggacacgtacctacccgggacgttccgggtccctgaccgattcgagccggcagcggtcngagacagactttcgaactctacaccctagtcacgtcaacgtccctgaccgtagggacctaggaaactagtaggttgacgttaggttttaacttaccgttgtacctagtaccgtagtttaattaagttagtaccgttaccttccgtaaggttaccgttttcggggaaccggggtaaccctaaggtcgttagggaacgtactaacggaaaccggtacttaggacgtaccgtacgtcccaaccgtgttccgtaccgttacgtttccnctttaccccg

SEQ ID NO: 4439 - DNA, 600 bp, Homo sapiens
  misc_feature: GYAE6OF02GLCI1.39.31.C09.1.454.CMB.1.raw
  modified_base (405)..(405): a, c, t, g, unknown or other
  misc_feature (405)..(405): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttgtaccagacagaaaccaggacagcctcctaagttgctctatttactgggcaatccgtacccgggagtccggggtaccctgaccgtattcagcgcaggcggtcagagacagtactttcactctacaccatcacgcacgcctgcaggctagaacgagtgnggctaagtttattacgttgtcagtcaagttattaagtagtagttacctacgtagttacgttttacggggacccggggtaacaaggtccgtagggactaacgtaccgtaaaacggtaacgtaggtacgggtaccgttacggccgtaaaccccgttacgttaccgttcggttaccctttacgtaccgtttacccccg

SEQ ID NO: 4440 - DNA, 607 bp, Homo sapiens
  misc_feature: GYAE6OF02I3Y0P.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaaacaataaagaattacttcgcttaggtaccagcaagaaaccaggacagcctcctaagttgctctatttactgggcatccgtacccggggagtccggggtccctgaccgattcagcgcaggcggtctgagacagtatttcactctacaccatcgagccagcctcgaccgaggactacggaagtacgtggtacggtacgtaagttttacttacgttgtacgacgtactaagttattaattagttaacgtcctagtacgttacgttttcggggacccggggtaaactaacggtcgtaggtagtacgtaacgaaaccggtaagttcggtaggtacctacggacctaacctaacgttcgttccgttacttccgacgtttaccccg

SEQ ID NO: 4441 - DNA, 569 bp, Homo sapiens
  misc_feature: GYAE6OF02FOPPD.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtcctgaccgtattcgagcggcaggcgggtctagagacagtatttcactctacaccatcagtcacgcctgcaggctaggaagtagtgtacggtctagtttattacgttgtctagctagttatttaagtagttacgtcctacgtacgttacgttttcggggcccggggtaacctaaggtcgtagggactacgtacgaaacggtacgtggtaggtacctgacctaccgtactcgttacgtaccttctacgttccccg

SEQ ID NO: 4442 - DNA, 500 bp, Homo sapiens
  misc_feature: GYAE6OF02IQC0C.39.31.C09.1.454.CMB.1.raw
  modified_base (475)..(475): a, c, t, g, unknown or other
  misc_feature (475)..(475): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaaccaggacagcctcctaaagttgctcatttaactgggcatctacccggggagtccgggggtccctggaccgattcagcggcagcggtctgagacagatttcactctcaccatcagcagctgcaggctgaagatgtggcagtttatacttgtcagcagtattatagtagtctcagtacttttggccggggtacaagctgagatcgaaacgaactnggctgcaccatctgtcttcgatccg

SEQ ID NO: 4443 - DNA, 566 bp, Homo sapiens
  misc_feature: GYAE6OF02FODBQ.39.31.C09.1.454.CMB.1.raw
  modified_base (381)..(381): a, c, t, g, unknown or other
  misc_feature (381)..(381): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgttttacactaggtaccaaacaataaagaattactcgcttggtaccagcagaaaccaggacagcctcctaagttgctctatttacgtgggcatccgtacccgggaggtcccggggtcctggaccgtattcagccggcaggcgggtctggagacagtactttacacttcncaccatccagcacgcctncgagctgaagntgtgctagttattactgtcagtctagttattatagtacgtacctagtacgttacgtttcgggaccggggtaccgaaacgcgtagggacgactacgaaacgtacgtacggtacggtcgtacgacctacgtactccgttgttcccttctacgttcccg

SEQ ID NO: 4444 - DNA, 716 bp, Homo sapiens
  misc_feature: GYAE6OF02F5ISL.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggacgggccaccatcaactgcaagtccagccagagttcgtttacacaggtaccaacaataagaattaccttcgacttggtaccagcaagaaaccaggacacgcctactaagttcgcttactatttacgtggggtcactccgtaaccccggggaggttccccgggggttcccctacggacccgtacgtttaccgacgggccggtcgaacgggtccggggttctacgggaacgacgtacggttaacttttcccgaaccgtttcctaccaacccgtaacgttaccgaacggtaccgaacgtccccgttcggaccgtacggtcgttaacgggaaacggtagttcggggttacgggtaccgttaaggtttttacctttaacgtcggttaccgaacgtacgttaagtttaatttagttaacgttacgtaccttacgttaacgttaccggttttacggggaccgggtaccacggtcgtaggacgtataccgaaggtacgtggtacgtcgtagaccgtactagtccgttgtaccttacgactttcccg

SEQ ID NO: 4445 - DNA, 602 bp, Homo sapiens
  misc_feature: GYAE6OF02JBAVW.39.31.C09.1.454.CMB.1.raw
  modified_base (387)..(387): a, c, t, g, unknown or other
  misc_feature (387)..(387): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgtcttggtaccagacaagaaaccaggaacacgacctacctaagttgctactatttacgtgggcatccgtaacccgggcggtccgggtccctcgacgtacttcagcggcacggccgggtctagagtacgagtatttacacgttcncaaccgatcaacgcacgccttgggacctagggtcttaaggaaacgttgtggtacggtacttaagtttacttacgtggtacccaaggtcctagttaacttaagagtcgttccacgagtttacgttcggggccgggtaaccagtccgtagggactacgtacgaaaaccggtgttgcggtacctgaccctacgtatcgttactacttataccgttccg

SEQ ID NO: 4446 - DNA, 646 bp, Homo sapiens
  misc_feature: GYAE6OF02JBBDQ.39.31.C09.1.454.CMB.1.raw
  modified_base (336)..(336): a, c, t, g, unknown or other
  misc_feature (336)..(336): n is a, c, g, or t
  modified_base (363)..(363): a, c, t, g, unknown or other
  misc_feature (363)..(363): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgacaagtccagccagagttgtttacacgtaggtaccaacaataaagaattacttcgtcttggtaccagcaagaaccaggacagccctacctaagtgctctatttacgtggctagtccgtaacccggggtagtcccggggtcccngtaccgtattcgagcggcaggccggtntgagacagtactttcactctaccaacctataccgagtccgacgcctcgacgtaacggtcgtaaggaacgtagtcggtaggtaccgttaagttttacttacgttcggtaccaaggttaccgtaagtttatttaacgttacgttacgttacccttacgtaacggtttaccggttttaccggggaaccggggtaaaccacggtcgtagggtaacgtacgttaacgaaaccgtggtacggtcggtcctcgaccgtactcgttccgtcgttacttccgtacttccccg

SEQ ID NO: 4447 - DNA, 620 bp, Homo sapiens
  misc_feature: GYAE6OF02GJR5W.39.31.C09.1.454.CMB.1.raw
  modified_base (294)..(294): a, c, t, g, unknown or other
  misc_feature (294)..(294): n is a, c, g, or t
  modified_base (350)..(350): a, c, t, g, unknown or other
  misc_feature (350)..(350): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttacacaggtccaacaataagaattacttcgcttggtaccagcagaaaccaggacacgcctacctaagtgctacatttacgnggcatccgtacccggagtccgggtcctgaccgattcagcgcaggcggtctgagacngtatttcactctcaccntacancacgcctgacacggctagaacgtagtggtacggtacttaagttttattaccgttagtacgagtactacgttaatttagttagttacgttaccttacgtagttaccggttttacggggaacccggggtaacctaacggtcgtagggtacgtacgttaaccgtaaacggtaacgttacgggtacggtccgttaacgcccttaaccgtacgtttaccgttacgttaccgtttaccgtaccgtttacccccg

SEQ ID NO: 4448 - DNA, 534 bp, Homo sapiens
  misc_feature: GYAE6OF02FKBI2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattacttgtcagcagtatatagtacgtcctacagttacgtttcgggaccgggggtaccaaggtcgtaggagactacgaaacggtaacgtggtacggcctgaccaccgtactcttcgtcctttacgacttcccg

SEQ ID NO: 4449 - DNA, 610 bp, Homo sapiens
  misc_feature: GYAE6OF02G1BZX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaacaataagaattaccttcgcttggtaccagcaagaaaccaggacagcctactaagttcgctctatttacgtggcactccgtacccgggacggtcccgggtcctgaccgattcgacgcggcaggcgggtctaggagactagtactttcactcgtacaacctataccagcacgcctcgacgacggctagaagtagtcggtagtcttaagtttattacgttgtacagtcgtaagttattaagttagttacgttaccgtacgtacgttacggttttcggggacccggggtaacgacgtcgtaggtacgtactacgaacgtacgtacggtcggtacgtacgacctaaccgtacgttaccgttcgttaccttaccgtaccgttccccg

SEQ ID NO: 4450 - DNA, 557 bp, Homo sapiens
  misc_feature: GYAE6OF02GHGYN.39.31.C09.1.454.CMB.1.raw
  modified_base (292)..(292): a, c, t, g, unknown or other
  misc_feature (292)..(292): n is a, c, g, or t
  modified_base (364)..(364): a, c, t, g, unknown or other
  misc_feature (364)..(364): n is a, c, g, or t
  modified_base (392)..(392): a, c, t, g, unknown or other
  misc_feature (392)..(392): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcgtacccgggagtccggggtccctgaccgattcacgcggcaggcggtctgagacagatttcactcncaccatcagcagcctgcaggctagaagntgtgctagtttattactgtacagactagttattagtagttacgtacctactacgttacgttttcgggacccgggggtaacctaaggcgtagggacgataccgaaaacggtaacgtggtacggtccgtaggaccaacgtacttcttgttccttaccgtattccccg

SEQ ID NO: 4451 - DNA, 512 bp, Homo sapiens
  misc_feature: GYAE6OF02FTVMZ.39.31.C09.1.454.CMB.1.raw
  modified_base (292)..(292): a, c, t, g, unknown or other
  misc_feature (292)..(292): n is a, c, g, or t
  modified_base (392)..(392): a, c, t, g, unknown or other
  misc_feature (392)..(392): n is a, c, g, or t
  modified_base (467)..(467): a, c, t, g, unknown or other
  misc_feature (467)..(467): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcctacccgggagtccggggtcctgaccgattcgagcggcagcgggtctgagacagatttcactctacaccatcagccagcctgcaggctgaagntgtggctagtttattactgtcagtcagtattatagtacgtctctagtacgtttcgggaccgggacaggctagganagtacaacgtaacgtgtcggctcgctacagtctgtcttcattccc

SEQ ID NO: 4452 - DNA, 578 bp, Homo sapiens
  misc_feature: GYAE6OF02HMIBV.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattactcgcttggtaccagcagaaaccaggacagcctcctaagttgctctatttacgtgggcatcctacccgggagtcccggggtcctgaccgattcagcggcaggcggtctgagacagtactttcactctacaccatcagcctagcctgaccgaggctaggaacgtatggtaggaccttaaggttttactacgttacgtacagtctaagttattacgttagtacgttccttacgagttacggttttcggggacccggggtaacacggtcgtaggagtactaacgaaacggtacgtggtcggactacgacaccgtagtccttcgttacttcctagttccccg

SEQ ID NO: 4453 - DNA, 560 bp, Homo sapiens
  misc_feature: GYAE6OF02IFEIC.39.31.C09.1.454.CMB.1.raw
  modified_base (307)..(307): a, c, t, g, unknown or other
  misc_feature (307)..(307): n is a, c, g, or t
  modified_base (346)..(346): a, c, t, g, unknown or other
  misc_feature (346)..(346): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcattactggcatcgtacccgggngtccgggtccctgaccgattcagcggcagcgggtctganacagtatttcactctcaccatcagcacgcctgcgagctagaagatgtgtctagtttattactgtcagactagtattatagttagtacctacgtagtacgttttcgggaccggggtacgaacggtcgttacggagtacgtaacgaaacggtaacgtacggtcgggacgtcgacctaccgtacgttccgttcgttacgtttaccgtactttccccg

SEQ ID NO: 4454 - DNA, 672 bp, Homo sapiens
  misc_feature: GYAE6OF02H9HA3.39.31.C09.1.454.CMB.1.raw
  modified_base (393)..(393): a, c, t, g, unknown or other
  misc_feature (393)..(393): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcggtgatgacccagtcctccagacctccctggctgtgtctctgggcgaggagggccaccatcaactgcaacgtccagccagagttcgttttacacaggtaccaaacaaataagtaattacttcgctttacggtaccagacaacgaaaccgaggacacgcctacctaagttgctctattacgtggcactccgacccgggtacgtcccgggtcctcgaccgatacgagcggacgacggcgggtctggacgacagtacttcactcncacactacagcacgccgtgcgacgtctaggaagtagtggtacggcttaggttttacttaccgtagttcgacgtacttaagttattaacgttagttaccgttaccgttacgtagggtttaaccggttttccggggggaacccggggtaacccgtaacggtcggttacgggaacgttaaccgttaaaccggtaaaaccgggtccgttagggtcggtaccgttacgaccctaccgttacgttccgtttaccggtttacctttacccgtaccgtttcccccgg

SEQ ID NO: 4455 - DNA, 516 bp, Homo sapiens
  misc_feature: GYAE6OF02GJSAI.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtcctgaccgattcagcggcagcggtctgagacagatttcactctcacatcagcagcctgcaggctgaagatgtggctagtttattacttgtcagctagtattatagttagtcctactagtacgtttcgggaccggggtaccaagtcgtggatatacgaaacgactgtcggtctcgactactactctgtcttcacttcccg

SEQ ID NO: 4456 - DNA, 650 bp, Homo sapiens
  misc_feature: GYAE6OF02GTJ8O.39.31.C09.1.454.CMB.1.raw
  modified_base (324)..(324): a, c, t, g, unknown or other
  misc_feature (324)..(324): n is a, c, g, or t
  modified_base (414)..(414): a, c, t, g, unknown or other
  misc_feature (414)..(414): n is a, c, g, or t
  modified_base (433)..(433): a, c, t, g, unknown or other
  misc_feature (433)..(433): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtccagccagagttgtttacacgacggtaccaaacaataagtaactttacttcgtacgttacggtaccagacaacgaaacccagggaaccacgccctacctaagttcgtctactagtttacgngggctacgtaccggtacccgggcggtcccggggtcctcgtaccgtattcgacggcggcgacgggtcggtcaggagacgtagtactttacncttctaccaccactcgacnccgacgccgtagcgtaggtctaggaagtagtggtcgtacgttagtttacgtacgttgtactagtacgtattattacgtacgttactcctaggtacggttacggtttccggggaccgggtaacacggtagtagggaacgtacgtaaccgaacggttaacgtcggtcgtaacgtccgtaccgtacctacgttcttaccgttacttccgtacctttcccg

SEQ ID NO: 4457 - DNA, 734 bp, Homo sapiens
  misc_feature: GYAE6OF02F3OGZ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccgacacgagtagtttacgtacaggtaccgtaaccaaataaagtaaattacttaccgtcgttacggtaccgaacgcacgaaaaccgaacggacgacgacctcccttaagttagtccgtctaatttacgttaggcgactacgtacccgggacggtcccgggtccgtacgaccgtacgtactacgcggcagacgggtcgtacgagacgatacgttactacgtaccttccaaccctatacctacgtaccgacgtaccgtcgtcgaaggtccgtaggtaacggaagtcggttaggacgttacgtttaatttacgttacggtcgaacgtaacgtagttaacgtttaacttacggttaacgttaccgtaccgtacggttaaccggtttttcggggtacccggggggaccgtaaaccgtacgggttaaccggtaagggtaacttaaccggtaaaaccgtaacgggtacgtcgggtacccgtaacgtaccgtaaccgtacgttccttaccgtactttacccgttacgttacccttacccccgg

SEQ ID NO: 4458 - DNA, 644 bp, Homo sapiens
  misc_feature: GYAE6OF02IRKTR.39.31.C09.1.454.CMB.1.raw
  modified_base (366)..(366): a, c, t, g, unknown or other
  misc_feature (366)..(366): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaacaataagaattaactcgacttggtaccagcagaaaccaggacagacctacctaagtcgctactatttactgggactagtccgtacccgggagtcccggggtcctagaccgtattcgaggccggcaggcgggtctgaanacagtatttcactctcacatcagcacgtctcgacacggctagaacgtagtggtacggtactagtttacttaacgttcgtacgaacgtacctaagttaatttaacgttaagttaccgttaccgtacgtaagttacgttttacggggacccgggggtaaacccaaacggtaccgttagggaacgtaagtaaccgtaaaaccggtaacgttacggtacgggtacctacggacctaaccgtacgttaccgttacggtttacctttaccgtaaccttccccgg

SEQ ID NO: 4459 - DNA, 708 bp, Homo sapiens
  misc_feature: GYAE6OF02JX4MI.39.31.C09.1.454.CMB.1.raw
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (669)..(669): a, c, t, g, unknown or other
  misc_feature (669)..(669): n is a, c, g, or t
tcagtcgcactagtcacgaccggtgctcgatttagacgtctcatcaaggaaggaaggggcagcaagatggtgttgcagacccaggtcttcatttctctgttgctctggatttctggtgcctacggggacatcgtgatgacccagtctccagactccctggctgtgtctcgtgggcgagagggccaccatcaactgacaacgtccagccagtagttagttttaccacgtacggtaccaaacaaattaaagtaatttacgttcgtctttacggtacccagcaacgaaaccgaggaacacgcctacctaagttcnctactatttacgngggactactccgtacccgggtacggttcccggggtacctcgaccgtagttccgaggtccggtacgacgggtcggttctaggaacgtacgagttacctttcaccttcgtaccacctacgtcacggtaccacggtaccctggtaccgaggtccgtaaaggaacgtgtcgggttacgtcgtttaaagttttacgttacgtgtacgcgttaacttaagttacttagtaacggttaccgtcttacgtaacgtttacggtttaccggggaaccgggtaccgtaaggtcggttaacggagtaaccgtaacgaaaccggtagtcgggtaaccgtgtaccgtaacgaccgttntaccggttcgttacttcccgttacgttccccttacccgg

SEQ ID NO: 4460 - DNA, 670 bp, Homo sapiens
  misc_feature: GYAE6OF02JD0ZH.39.31.C09.1.454.CMB.1.raw
  modified_base (369)..(369): a, c, t, g, unknown or other
  misc_feature (369)..(369): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagagggccaccatcaactgcaagtccagccagagtgtttacacaggtaccaacaataagaattactcgcttggtaccagcagaaaccaggacacgcctacctaagttcgactctattacgtgggactacgtccgtacccgggaggtcccgggtccctgaccgtacttcgaggtcgcaggccggtctagacgacngtatttcgaactccgtcaccatccgacgtcacgtcctcgacacggctagaacgtagtggtacggtacgttacggtttaacttacgttcgtactacgtacgtaagttaacttattaacggttacgttaccgtacgtaacggttacggttttacggggacccggggtaaccggttaacggacgttacgggtaacggtacgttaacgaaaaccggtacgtttaacgggtcggtaccgttaaccggacccgtaaccgtacgttacccggttacggtttacccgttaccgtaccgtttacccccgg

SEQ ID NO: 4461 - DNA, 492 bp, Homo sapiens
  misc_feature: GYAE6OF02I3333.39.31.C09.1.454.CMB.1.raw
tcagtcgcactagtcacgaccggtgctcgatttagacgtctcatcaaggaaggaaggggcagcaagatggtgttgcagacccaggtcttcatttctctcttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggatccggggtccctgaccgattcagcggcagcggtctgagacagatttcactctcaccatcagcagcctgcaggctgaagatgtggcagtttatgctgtcagcagtattatagtagtcctcagacttttgccggggacaagctggagatacgaaacgaactagtgctggcacgatctgtcttctac

SEQ ID NO: 4462 - DNA, 747 bp, Homo sapiens
  misc_feature: GYAE6OF02G7SM0.39.31.C09.1.454.CMB.1.raw
  modified_base (178)..(178): a, c, t, g, unknown or other
  misc_feature (178)..(178): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacgggacatcgtgatgacccagtctccagactccctggctgtgtctctgggcgagngggccaccatcaactgcaagtccagccagagtgtttacacaggtaccaaacaataagaaattacttacgcttaggtaaccagacaagaaaacctaggaacacgcctacgtaagttcgacttacatttacgtggaccagtccgtaacccggacggttaccggggtcccctacggaacccgtattacgaacgggccgacgtacggcggggttacaggtaaacgaccgtaagtacgttttacaccgtacctaccgacctaaacgtccgaagacccacggtccgtacgccgaacggtaccgtaggaagtacgtaggtacgggacgttaacgttttactttaaccgttagtaccgtaacggtacttacggtttaaataacgtttaagtaccgtttacctaaccgttacgttaaccggtttttccgggggaaccgggggtaaacccgaagtcccggttaagggtaaccgtacgtaacccggtaaacggtaaacggttcgttacggggtaacctaccggtaccctaacggtacccgttaacgtttccggtttaccctttcgaaccgttttccccgg

SEQ ID NO: 4463 - DNA, 803 bp, Homo sapiens
  misc_feature: GYAE6OF02JX3SP.39.31.C09.1.454.CMB.1.raw
  modified_base (703)..(703): a, c, t, g, unknown or other
  misc_feature (703)..(703): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactcctggctgtgtctcgtgggcgaggtacggccaccatccgaactgaccaacgtccagcccagtacgttagttttaaccgacgtacggtaccaaacgtaaattaaagtaacttacgtttacgccgtttacggtaaccaagccgtaaacgaaaacccgaggacctaaccggtacccttaccgttaaacggttgaccttcttaacgtttacgtcgggactacgttaccgtacccgggtacgggttccccggggtaccctacggaccgtattaccgcggtaccggacggaacggtccggggttacgtagtaaacggaacctacggttactttaccgaccgttccgtacctaaccgtacgtccgtaacgccgtaacgtccgtcgaccgtagggtacctaacgggaacgtaacgtcgggtacgttacgtttaaacggttttaattcccgttagggtaccctaaggttaacgtaacgtttagtttaggtttaacgttaccggcctttaacgggtaacgggtttacggtttaccgggggaacccggaacttaacgggtnaacgggggaactacgtaaaaccggtaaccgtaacggtggttaccggtaacgttccgaacgttaccgtactccggttacgtccgtttaacttcctacccgg

SEQ ID NO: 4464 - DNA, 603 bp, Homo sapiens
  misc_feature: GYAE6OF02FWF1T.39.31.C09.1.454.CMB.1.raw
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacacgcctcctaagttgctctatttacnggcatccgtaacccgggngtccggggtccctggaccgtattcgacgcggcacggcggtctggacgacagtatttcaactctcacactcagccagcctgcgaggctagaacgagtgtggtactagtttattacttcggtacacgtactagtattagtacgtacgtaccgtactacgttacgttttcgggacccgggggtaaccaaggtccgtagggacgtacgtaccgtaaaccggtaacggttacggtacggtaccgtcgaccgtaacctacgttaccgttcggtttacctttccgtactttacccccg

SEQ ID NO: 4465 - DNA, 578 bp, Homo sapiens
  misc_feature: GYAE6OF02GODT1.39.31.C09.1.454.CMB.1.raw
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctaccgggagtccggggtcctgaccgattcagtcgcaggcgggtctggagacagtatttcactctcaccntcagacngcctgcaggctagaagtatgtgcctagtttattactgtacacgactagtatttaagtagttacgtaccttactacggtaactttttcgggacccgggggtaacctaacggacgtagggaagtactacgtaaaccggtaacgtaggtacggacgtcgaccgtacccgtaacttaccgttcggttaccttaccgtagtttccccg

SEQ ID NO: 4466 - DNA, 758 bp, Homo sapiens
  misc_feature: GYAE6OF02FGC23.39.31.C09.1.454.CMB.1.raw
  modified_base (163)..(163): a, c, t, g, unknown or other
  misc_feature (163)..(163): n is a, c, g, or t
  modified_base (462)..(462): a, c, t, g, unknown or other
  misc_feature (462)..(462): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctgctgtntctgtggcgaggacggcccactactcaacgtgactaacgtccgagtccgagtagttacgtttacacgtacggtaccaaacaataaagtaactttaccttcgtacgtttacggaccagtaccaacgaaaccgaggactacgcctaccgtaagtcgtctactagtttacgcggactactaccggtaccggtacggtcccgggttcctacgtaccgtattaccgacggtacggacacgggccggttcaggacgacgtaagtttaccttaccgaccttcaaccaacctacgtaccgacgaccncgtacccgtcgacggacggacttaggaacggtacgtgggtaccggtaagttacgtttaagtttaccttaggtacgtaagtacctaagtttaacgttaagttaacgttacgtaccgttacgttaacgttaaccgggttttaccggggaacccggggttaacgtaaccggtcggtaacgggtaacgtaccgtaaaccgaaaccggttaaacggtacgggttaccgtaaccgtacgtaaccctaacccgtacgtttacccgttacgtttacccgtttaaccttacccgtttacccccgg

SEQ ID NO: 4467 - DNA, 865 bp, Homo sapiens
  misc_feature: GYAE6OF02IJRMP.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacactagtccaaacaataagtaattacttcgcttaggtaccagtacaagaaaaccaacggacacgacctacccgttaaagttacgccttctaacttttacgtgggtaccacgttaccggaaccccggggtacgggttacccccggggtccccgtacggtaaccccgtacgttttacccgaacggcccggggtccgtaacgggtccgggggttacctacgggaacggtaaccgtaaacggttacttttacctaaccgttaccttaccaaacccctaattaccgtaaccggacctaaccggtccccgtttacgggaccgtaaccggggtaccgttaaggtaaacgggtaaagtttcgggtacggggttaccgttaagttttttaaaccgtttaccgtttcggtttacaacggtaaccttaacggtttaaacgttttaacgttaacggtttaaccgtttcccgttaacgtaaccgggtttaacccggtttttacgggggaccccgggggttaaaccgtaaaccggtcggtacgggtaacgtacggttaaaccgtaaaacccgggttaacgttacggttaccgggtacgttaccggaaccgtaacccgttactttaccggttacggtttaccctttacctacgtttacccccgg

SEQ ID NO: 4468 - DNA, 584 bp, Homo sapiens
  misc_feature: GYAE6OF02F70QB.39.31.C09.1.454.CMB.1.raw
  modified_base (408)..(408): a, c, t, g, unknown or other
  misc_feature (408)..(408): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttacacaggtaccaacaataagaattacttcgcttggtacagacagaaaccaggacagcctcctaagttgctactatttacgtggacataccgtacccggggagtccggggtcctgaccgattcagcggacacgcggtctgagactagtatttcacgttctaccacactcagcacgtcctgcaggctagaaagntgtacggtacttaaggtttacttacgtcgtacacgtactagttattagttagttacgttcctgtaacgtttacggtttacggggacccgggtaactacgtgtacggagtactaaccgaaacggttactcggtacggtcgtcgactaccgtctacgttgtaccttactacttccccg

SEQ ID NO: 4469 - DNA, 626 bp, Homo sapiens
  misc_feature: GYAE6OF02IQXQA.39.31.C09.1.454.CMB.1.raw
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacgggacatcgtgatgacccagtctccagacctccctggctgtgtctcgtgggcgagagggccaccatcaactgacaagtccagccagagttgtttacacacggtaccaacaataagaattacttcgcttaggaccagacaagaaaccaggacagcctactaagtcgactctattcgnggctatccgtaccggngtccgggtcctcggaccgtagtacacggcggacgacggcggtactagacgacgagtcttttaccacttacctacgaacctataccgaacgcgacgtccgtacgctacggctagaagtagtcggacgtactacgtttaactacgtgtacacgtagtaacgtacttaatacggtacttcctagtacgttacggtttccgggaccggggtaaccaacgtaccggtggtaacgacgtaacgtaaacggaacggttacggaggtaccgtacgaacctacgtacgttccgttcggtaccttacgtaccgttacccg

SEQ ID NO: 4470 - DNA, 627 bp, Homo sapiens
  misc_feature: GYAE6OF02J0LN2.39.31.C09.1.454.CMB.1.raw
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttacacaggtaccaacaataagaattacttcgcttggtaccagcaagaaaccagacagcctacctaagttgctctattacgngggcataccgtacccggggtacggtccggggtaccctggaccgtacttccgagccggcgacggtcgggtctggacgacgtagtactttcaccgtctaccaaccagtaccacgccacgccgtagccgagggtctaggaaactgtggtcggtacttagtttactacgttcacgtacgcttagtaatttagtacgtcgtacctagtacgttacggtttcggggaccgggtaaccagtcggtagacgtacttaccggaaacgtccgttggtacggtacctacgaacctaccgtacgtttccgttacggttacctttacccgtacgtttacccccg

SEQ ID NO: 4471 - DNA, 670 bp, Homo sapiens
  misc_feature: GYAE6OF02HEDC9.39.31.C09.1.454.CMB.1.raw
  modified_base (118)..(118): a, c, t, g, unknown or other
  misc_feature (118)..(118): n is a, c, g, or t
tcagtcgcactagtcacgaccggtgctcgatttagacgtctcatcaaggaaggaaggggcagcaagatggtgttgcagacccaggtcttcatttctctgttgctctggatctctggtncctacggggacatcgtgatgacccagtctccagactccctggctgtgtccctgggcgagagggccaccatcaactgcaagtccagccagattgttttacacaggtccaaacaataagaattacttcgcttggtaccagcagaaaccaggacagccctacctaagttgctcattttactggggcatctaccccgggtagtccggggtccctgacgacttcagcggcacggcgggtctgagacagtatttcactctcaccactcagcagccctgcgacggtctacggaagtctaggttgggcttagttttaacgtttacgttctttacgacgttaacgagtttagttaacgtttaggtaacgttcccttacgtaacggtttaaccgggtttttcgggacccggggggtaacccttaaggtaccggtacgggtaagggtaaccgttaccgaaaacccgggtaacgtttcggggttacggccggttaacggtaccgtaacccgtaactttcggttacccgtttctttaccccttagttacccccgtttacccccgg

SEQ ID NO: 4472 - DNA, 591 bp, Homo sapiens
  misc_feature: GYAE6OF02GV92J.39.31.C09.1.454.CMB.1.raw
  modified_base (297)..(297): a, c, t, g, unknown or other
  misc_feature (297)..(297): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggcccaccatcaactgcaagtccagccagagttgtttacacaggtccaaacaataagaattacttcgcttggtaccagcagaaaccaggacagccctactaagttcgctctatttacngggcatccgtacccgggaggtcccgggtccctggaccgtattcgagccggcaggccgggtctggagacgagtatttcactctcaccatcagcacgcctgcgaggctagaagtatgtggactagtttactacttgtacagtctaagtatttacgtagttacgtcctgtaagttaccggtttacggggacccgggggtaactaacggtcgtagggtaagtactaccggaaaccgtaacgttaggtacggtacgttccgaccaccttacgtccgttacgtctttaccgacttccccg

SEQ ID NO: 4473 - DNA, 661 bp, Homo sapiens
  misc_feature: GYAE6OF02G82QO.39.31.C09.1.454.CMB.1.raw
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtccaacaataagtaattactcgcttggaccagcagaaaccaggacagcctacctaagttgctctatttacngggctatccgtacccgggngtccggggtccctgaccgtattcgagcggcaggcgggtctgacgacagtactttcactctccacctatcacgcgacgcccgtgacgtaggtactaggaagagttggtaggtcttaagttttattacgttggtacaggtactaagttatttagtaacggttacgttacccttacgtacggtttaccggttttacgggggaccccggggttaacctaacgggtaccgttaagggaccgtaacgttaacccgtaaacccggtaacggttacgggttacggtacccgttacggtacccgtaaccgttacgtttaccgtttacggtttaccctttacctaacccgtttcccccg

SEQ ID NO: 4474 - DNA, 710 bp, Homo sapiens
  misc_feature: GYAE6OF02INH6N.39.31.C09.1.454.CMB.1.raw
  modified_base (321)..(321): a, c, t, g, unknown or other
  misc_feature (321)..(321): n is a, c, g, or t
  modified_base (672)..(672): a, c, t, g, unknown or other
  misc_feature (672)..(672): n is a, c, g, or t
tcagtcgcactagtcacgaccggtgctcgatttagacgtctcatcaaggaaggaaggggcagcaagatggtgtcgcagacccaggtcttcatttctctgttgctctggatctctggtcgccgtacggggacatcgtgatcgacccagtctccagacctccctggctgtcgtctcgtgggcgaggacgggccacatcaactgacaagtccagaccagagttcgtttaacacgacggtccaaacaataagtaacttactcgtacttcggaaccagacaagaaaccaggacacgtcctacgtaagttcgactactaatttacgnggtcacgtccgaccgggtaggtcccgggtccacgtacgtacttcgacggtcggacacgggtcggtctaggaagaaccgtgttaactttccacgtacctaccaactaatccgaagccacgtccgtcgacgacggtacgtacggtaaaggtcttagggtacggtacgttaacgttttaacgttaacgttcggtacgtacggtacgttaacgttaattaagttacggttaactaccgtacgtaacgttacgggttttccgggaacccggggtaacgtacggtcgtacggtaacgtacgtaaaccgtaaaccggtaaggttaccggtacggtaccgtaccgtaccgtaaccgttnttacccgttacggttaccttacggttacccttacccgg

SEQ ID NO: 4475 - DNA, 980 bp, Homo sapiens
  misc_feature: GYAE6OF02HLKVQ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagaggccaccatcaactgacaagtccagccagagttgtttacacgaggtaccaaacaaataagtaaatttacgttcggtcttaggtaacccgaggtcaacgaaaacccgaggaccaaggtccctacgttaaagttcgcttactaacgttttaacgtcgggtacctacgttacccggttaaccccgggggtacggtttcccccggggggtacccccgttaacggtaaccccggtaacgtttacccggtaacgggcccccggggtaaccggttaaccggggtccggggggttacccttacggggaaaccggtaaacgacggtttaacctttttaacccccgaaccgtttaccctccccgtaaaacccctattaccggaaccggtaccgtaaaccggtcccccggtttacggaccggtaacgggtacccgtttaaacgggtaaaacggtaaccggtttacggggtaccgggtaaccgtttaaacggttttttaaaccggtttaccggtttaaccggtttaccggtaaggtacccgttaaaacggttttaagtttaaacggtttttaaacgggtttaaccggttttaccccgtttaaccggtaaacggggttttttaacccggggttttaccggggggtaacccccggggggttaaaaccctaacgggtaccggttacggggtaaacggttaccgttaaacccggttaaaacgggtaaccggttaccgggttacgggttcccgaaccggttaccgtaaccgtttacgttcccttacgggttttaccttaccgtaccttttacccccgg

SEQ ID NO: 4476 - DNA, 823 bp, Homo sapiens
  misc_feature: GYAE6OF02IR80X.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctctgggcgagacgggccaccatcaactgacaagtccagccagagttgtttaacacgtaggtaccaaacaataaagaattacttcgcttaggtaccagacaacgaaaccaggaacacgaccttaccgtaagttcgaccttactagttttaaccgtggggactaacgttaccggtaacccggggacggttcccggggtacccctacgggtaaccgtagtttacccgaacgggccccgggtacgtaccgggtacccggggttaccgtaggaaccggtaaccgtacgttaacggtttttacccaaccggtttaccctacccgtaacccctaagtaccgaacggtaccctaacggtccccgttacggaccgtaacgggtaccgttaacggtaacgttaaggtcgggtttaacgggtacgttttaacggtttttaacgttttaccggttaacggtttaccgtaaccgtaaccgttaaaggtttaatttaaagttaacggttaaccggttaccgtttacgaaccgtttacgggtttttaaccggggacccgggggttaaaccgaaacgtcggttacgggaacgtacgtaacgtaaacggttaacgtacggtggtaccgtacgaccgtacctacgttccttcggtaccttacgtacttacccg

SEQ ID NO: 4477 - DNA, 554 bp, Homo sapiens
  misc_feature: GYAE6OF02JJEVT.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctctatttacgtggcatcgtacccgggagtcccggggtcctgaccgattcgagcggcagcggtctagacgacagtatttacactctcaccatcagcacgcctgcacggctaggaatagtggtgtactagtttattactgtcgagcagttatagttagtactacctactacgttacggtttcgggaccggggtacaaggtcttaggacgtataacgaacgtacgttagtcggtactacgacacctacgttccgtagttccttacgtacttcccg

SEQ ID NO: 4478 - DNA, 615 bp, Homo sapiens
  misc_feature: GYAE6OF02H8Y6O.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgttttacacaggtaccaaacaataagaattacttcgcttggtaccagcaagaaaccaggacagcctacctaagttgctactaatttacgtgggctatccgtacccgggaggtcccgggtccctggaccgtattcgaggcggcaggtcgggtctaggacgacagtactttcactctaccacatcagcacgcctgcgtacgacgtagaagtagtggtggtactagttttattacgtgttacagtactaagttattaagttagttacgttaccttacgtacgttacggttttcggggacccggggtaaccgtaaggtacgtagggtagtacgtaacgaaacggtacgtacggtcggtacgttcgaccgacctacgttcgttacgttactttacctactttaccccg

SEQ ID NO: 4479 - DNA, 683 bp, Homo sapiens
  misc_feature: GYAE6OF02JN4KL.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgaggacgggccaccatcaactgacaagtccagccagagttgtttacacaggtaccaacaaataagtaaatttaccgttcgtccgtttaggtaacccagaccaaacggaaaaccacgggaacacgtaccccttaccgtaaagttcgcttacgtatttacgtgggcctacgtccggtaacccggggacggttccccggggtccctacggtacccgtactttccgaggccggcgaggtcgggtctagggaacgaacgtagtacttttcaccgtcctaccaccactcgaacgcacgtacctggcgacggacgtaggtaacgtgtaggtacggtacttaagtttagttacgttcgtacgtaacgtctacgttattacgttagtaccgttcttacgtacgttacggttttcgggaccgggtaacgtaacgacgttagaacgtacgtaacgaacgtaacgtaggtagtaccgtcgaaccgtaccttgttaccgttcgtacttaccgtcgttacccg

SEQ ID NO: 4480 - DNA, 612 bp, Homo sapiens
  misc_feature: GYAE6OF02GT1C2.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtagttttacacaggtaccaaacaataagaattacttcgcttggtaccagcaagaaaccaggacagcctcctaagtcgctacatttacgnggcatcgaccggacgtccggggtcctgaccgatcgagcggacagcgggtctagacgactagatttacgactcactaccatacgagtcagcctgcacggctacgaaagctggtacggacttaagtttaacttacgttgtacgtagtacgtaagtaattaagttacgtaacgttcctagtacggttacgtttacggggccggggtaaccgagtccgttagggacgtaacgtaccgaaaacggtactacgggttacgggcgttaccgacctaacccgtaacgttccgtacgtttaccgttacctacgtttacccccg

SEQ ID NO: 4481 - DNA, 605 bp, Homo sapiens
  misc_feature: GYAE6OF02FTJQY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcagaggccaccatcaactgcaagtccagccagagtgtttacacaggtccaaacaataagattacttcgcttggtaccagcagaaaccaggaacagcctcctaagttgcttcatttactcgggtcatcctacccggagtccggggtcctgaccgattcagcggtcacggcggtctgactaccagactttcgacttctacacctatcagcagcctgctacggctaggaagtactcggtacggactaagtttacttacgttacgtctagtcgtacgttatttaagtacgttacgttacccgttactagtaccgttttacggggacccggggtaactaaacggtcgtcggaacgtacttaaccgaaacgtaacgtcggtacggtccttacgtacgaccccgtagttcccgttagtccgtttaccacgtttaccccg

SEQ ID NO: 4482 - DNA, 601 bp, Homo sapiens
  misc_feature: GYAE6OF02GU0OP.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctacctaagttcgctctatttacgtgggctatccgtacccggggaggtcccggggtccctggaccgtattccgaggcggcgaggcgggtctggagacagtactttcactctcacatcagcagtccgtgcgaggctaggaagtagtcggtggtctagttttattacgtcgtacagtacgtaagttattagtagttacgtaccttacgtacgttaccggttttacgggaccggggtaacctaaggtcgtagggacgtacgtaacgaaacggtacgtacggtacggtcgtacggacctaccgtactccgtacgttccttacctacgttccccg

SEQ ID NO: 4483 - DNA, 717 bp, Homo sapiens
  misc_feature: GYAE6OF02H564J.39.31.C09.1.454.CMB.1.raw
  modified_base (180)..(180): a, c, t, g, unknown or other
  misc_feature (180)..(180): n is a, c, g, or t
  modified_base (428)..(428): a, c, t, g, unknown or other
  misc_feature (428)..(428): n is a, c, g, or t
tcagtcgcactagtcacgaccggtgctcgatttagacgtctcatcaaggaaggaagggggcagcaagatggtgttgcagacccaggtcttcatttctctgttgctctggatctcgtggtgcctacggggacatcgtgatgacccagtctccagactccctggctgtgtctctgggcgagngggccacatcaactgcacgtccagccagagttgtttacacaaggtccaaacaataagaattacttcgcttacggtaccagacagaaaccagacagcctactaagttcgactactactttacgtcgggactacgtccgtaacccggggacggtcccgggggtccctggtaacccgtattcgaacggtccggacgtaggtccgggtctagagtaacgagtctttacgactctaccgaacctatcagtccncggtacctcggaccagggtacgtagaaaggtacttaggtacggtacttaaggttttaacgttaaccgtacgtttaccaagtacttaaagttaacgtttaacttaacggtacgttacccgtacgttaacggttaaccggtttttacggggaacccggggtaaaccggaaacggttaccggtagggaacgtacgttaaaccgtaaaaaccggttaaccgtacgggttaacgggtacgtttacggaaccgtaccgtaacgtccgttcgtaacctttaccacgtttaaccccg

SEQ ID NO: 4484 - DNA, 622 bp, Homo sapiens
  misc_feature: GYAE6OF02JISXY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagagtgttttacacacggtccaacaataagaattacttcgcttgtaccagcagaaaccaggaacacgcctactaagttgctctattacgtggcatccgtacccgggagttccgggtcctgaccgtattcagcggcacggcggtctgacgacgagtatttcacgttctaccgacctactcacgtcacgcctcgacaggtctaggaagtagtggtcgacgttacgtttaagttacttcgtacgacgtaccgtaagttaacttaagttacggttacgtacccttacgtacgttaccggttttacggggacccggggttaacgacggtacggtacgtaagtacgtaacgtaacggtaacgtggttacggtacgtacgacccgtaacgtacttaccgtacgttaccttactaccgttcccg

SEQ ID NO: 4485 - DNA, 625 bp, Homo sapiens
  misc_feature: GYAE6OF02GO556.39.31.C09.1.454.CMB.1.raw
  modified_base (284)..(284): a, c, t, g, unknown or other
  misc_feature (284)..(284): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagccagccagagttgtttacacaggtaccaacaataaagaattacttcgcttaggaccagcaagaaaccaggacagcctacttaagtnctctatttacgtggctactccgtacccgggacgtcccggggtccctcgaccgtattcgcgcggacgaggcgggtctaggacgtacagttactttacaccgtcctacaaccgtatacacgcacgcgtcgcgaggcctaggaagtagtggtacggtacttaaggttttacttacgttcgacgtagtacgttaagttatttacgttaagtaccgttacgttacgaggtttaccggttcggggaacccgggtaacgtaacgtacgtagggtaagacttaacgaaacgtacgtacggttagcgttagccctaacgtctcgttcgttaccgttactaccgttccccg

SEQ ID NO: 4486 - DNA, 544 bp, Homo sapiens
  misc_feature: GYAE6OF02FIMAU.39.31.C09.1.454.CMB.1.raw
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (352)..(352): a, c, t, g, unknown or other
  misc_feature (352)..(352): n is a, c, g, or t
  modified_base (389)..(389): a, c, t, g, unknown or other
  misc_feature (389)..(389): n is a, c, g, or t
  modified_base (452)..(452): a, c, t, g, unknown or other
  misc_feature (452)..(452): n is a, c, g, or t
tcagtcgcactagtcacgaccggtgctcgatttagacgtctcatcaaggaaggaagggcagcaagatggtgttgcagacccaggtcttcatttctctgttgctctggatctctggtgccgtacggggacatcgtgatgacccagtctccagacctccctggctgtgtctcgtgggcgagagggccaccatacaactgcaagtccagccagtagttgtttacacaggtacccaaacaataagaattacttcgtcttgtaccagcagaaaccaggacagcctctaagttnctctatttacnggactatccgtacccgggacgtcccggggtccctcgaccgtatcgagcggacnggcgggtctgagactagtctttcactctacacatcanctacgctgcagctagagagtgtgacgtattattactgtcagtactatatagtagtagtccgtntacgtcggtttcgggaccgggtacacgtcgtagagtactacgaacgtacgtagtacggcgtacgcgactacgtacgtcgtctactctacccg

SEQ ID NO: 4487 - DNA, 601 bp, Homo sapiens
  misc_feature: GYAE6OF02IIMOR.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttacacaggtaccaacaataagaattacttcgcttggtaccagcaagaaaccaggacagcctactaagttgctctaatttacgngggcacgttccgtacccggggtacggtcccggggtcctcgaccgtattccgaggccggacgacggcgggtctaggagacagtactttcgactctacaaccataccgagccgacgcctcgcgacggactagaagtgttaggtggtacgttagttttattacgttacgtacagtactagttattagtagttacgtcctacgtagttacgtttcgggaccgggtaacgagtcgtaggacgtactacgaacgtagtcggtacggtacctacgaccgtacgacttcgtacgttccttcctacttcccg

SEQ ID NO: 4488 - DNA, 532 bp, Homo sapiens
  misc_feature: GYAE6OF02IXBLD.39.31.C09.1.454.CMB.1.raw
  modified_base (212)..(212): a, c, t, g, unknown or other
  misc_feature (212)..(212): n is a, c, g, or t
  modified_base (293)..(293): a, c, t, g, unknown or other
  misc_feature (293)..(293): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctatgtctctgggcgagagggccaccatcaactgcaagtccagccagagttnttttacacaggtccaacaataagaattactcgcttcggtaccagcagaaaccaggacagcctcctaagttgctcatttacngggactactcgtacccgggagtccggggtccctgaccgacttcagcggtacaggcgggtctggacacagtatttcactctacaacatcancganccngcagcanaagatgtgctagtttacttagtgtcagcattataatagtatacctgtacgtacgtttcgggaccggggaaccaagcgtagatatacgaaacgtactaggtgctaccgacaccgtactcttntacttnacttcccg

SEQ ID NO: 4489 - DNA, 595 bp, Homo sapiens
  misc_feature: GYAE6OF02JFXCU.39.31.C09.1.454.CMB.1.raw
  modified_base (206)..(206): a, c, t, g, unknown or other
  misc_feature (206)..(206): n is a, c, g, or t
  modified_base (352)..(352): a, c, t, g, unknown or other
  misc_feature (352)..(352): n is a, c, g, or t
tcagtcgcactagtcacgaccggtgctcgatttagacgtctcatcaaggaaggaagggcagcaagatggtgttgcagacccaggtcttcatttctctgttgttctggatctctggtgcctacggggacatcgtgatgacccagtctccagactccctggctgtgtctctggcgagagggccaccatcaactgcaagtccagccagngtgttttacacaggtccaacaataagaattacttcgcttggtaccagtcagtaaaccaggacagcctctaagttgctcatttactgggcatctacccgggagtccggggtcctgaccgattcgagtggcagcgggtctgagacagntttcactctcgaccatcagcagcctgcacggctgaagtatgtcggctagtttatactgtcagctacgtattacgtagtagtccttacgagttaccgttttgggacccgggggtaacctaaaggcccgtttagggaacgtacgtaccgtaaacgtaaccggttacggtacggtaccgttccgacctaaccccgtagttacccgttacggttacccgtttaccgaactttcccgttaacccccgg

SEQ ID NO: 4490 - DNA, 576 bp, Homo sapiens
  misc_feature: GYAE6OF02GU4GN.39.31.C09.1.454.CMB.1.raw
  modified_base (297)..(297): a, c, t, g, unknown or other
  misc_feature (297)..(297): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagtgtttacacaggtccaaacaataagaattacttcgcttggtaccagcaagaaaccaggacagcctcctaagttgctctaatttacgngggcatctacccggggagtcccggggtccctggaccgtattcgaggccggcaggcggtctgacgacagtatttcactctaccacatcagcagcctgctaggctagaagtntgtgngtatttatacgtgtcagctagttattagtagttatcctacgaagtcggttttacggggaccggggtaacctaaaggcgttagggagtacgtaacgaaacggtacgttcggtacggcttagacccgtaactacgttccgtccgttcgtttaccaccgtttccccg

SEQ ID NO: 4491 - DNA, 742 bp, Homo sapiens
  misc_feature: GYAE6OF02GU8XM.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtcctccagacctccctggctgtgtctcgtgggcgagacgggccaccataccaactgcaagtccacgccagtagttcgtttacacacggtaccaaacaaataaagtaacttacttcgtcgtttacggtaaccagtacaaacgaaaaccgaggaaccacgtaccctaccttaagttcgtcctacttatttaccgtgggcctacgtacccggtacccggggtaacggttcccgggggtcccctacggaccggtacttcgacggccggacgtacgggcgggtactagggacgaacgacgtactttacccacgttcctaccgtaaccacttaccgaacgcctaaccggtccgtcgaccggtacgggtacgtaagggtaacgtaggttacggtacgggttaacgttaaggttttacttaacggttcgtactaaggtacttaacggttatttaaagtacgttaccgtaccttaccggtagttaccgggtttacggggacccgggtaacgtaacggtcggtaagggactacggtaacgaaacgtcggtacggtcgtacgtacgtaccgacctaacggttctcgtttacctaccttcgttaccccg

SEQ ID NO: 4492 - DNA, 601 bp, Homo sapiens
  misc_feature: GYAE6OF02FPR3R.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttacacaggtccaaacaataagaattacttcgcttggtaccagcagaaaccagacagcctaccgtaagttgctctatttacnggcatcgacccgggagtccggggtcctgaccgattcgagcgcaggcggtctgacgacagtatttcactctacaccatcagcagcctgacgaggctagaagatgtgtactagtttaattacgtagtcaggtactaagttattaagtacgttacgtcctacgtaacggttaccgttttacggggacccggggtaactaaacggtccgttagggaacctagtaaccgaaagttacggaaactttcgggtacggtacctacggtacccaacccgttaagttacccgtttggttacccgttaccttaaccccg

SEQ ID NO: 4493 - DNA, 525 bp, Homo sapiens
  misc_feature: GYAE6OF02I4Q68.39.31.C09.1.454.CMB.1.raw
  modified_base (245)..(245): a, c, t, g, unknown or other
  misc_feature (245)..(245): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgnttggtaccagcagaaaccaggacagcctcctaagttgctcatttactgggcagtcacccgggagtccggggtccctgaccgattcagcggcagcgggtctgagacagatttcactctcaccatcagcagcctgcagctgaagagtgtggctagtttattactgtcagctagttattatagtagtcctacgtagttacgttttcgggccggggtaaccgagtcgtaggagtagtacaaacggtagtagtggctgacctacattcctagtcttcagttcccg

SEQ ID NO: 4494 - DNA, 574 bp, Homo sapiens
  misc_feature: GYAE6OF02GBBEG.39.31.C09.1.454.CMB.1.raw
  modified_base (291)..(291): a, c, t, g, unknown or other
  misc_feature (291)..(291): n is a, c, g, or t
  modified_base (371)..(371): a, c, t, g, unknown or other
  misc_feature (371)..(371): n is a, c, g, or t
  modified_base (391)..(391): a, c, t, g, unknown or other
  misc_feature (391)..(391): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcagaaaccaggacagcctctaagttgctcatttacngggcatccgtacccgggagtccgggtcctgaccgtattcagcgcagcggtctgagacagtactttcacttctccactacncagcagctgcaggctgaatntgtgactagttatactgtacagtctagttacttagtagtaacttccgtctaagttcgttttacggggacccggggtaacctaacggccgtagggtaactacttaaccgtaaaacggtacgttggttaccgggtactaacggcctaacgtacttccgttaggttcctttcgacctttaccccgg

SEQ ID NO: 4495 - DNA, 667 bp, Homo sapiens
  misc_feature: GYAE6OF02ICZPZ.39.31.C09.1.454.CMB.1.raw
  modified_base (459)..(459): a, c, t, g, unknown or other
  misc_feature (459)..(459): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaacgtccagccagtagttgttttacacaggtaccaaacaaataagtaattacttcgtcttacggtaccaagcaacgaaaccgaggacacgcctacttaagttcgactactattttacgtgggactacgtaccgtacccggggtacggttccccggggtccctacggtacccgtattaccgacggccggacgtacgggtccgggtctaggacgaactaggtacttttcacctccgtaccaaccactacagctacgcctcggacnggaccgttagaagtagttggtaggcttaagttttattacgttctacgagtactaaggttacttagttacgttacgtacctacgtacggttacggtttccggggaaccgggtaccaaggtcgtagggtacacgttaaccgaacggtaacgttacggcggtcgtaccgtacgacccgttatccgttacgtccctttacgacccgttcccg

SEQ ID NO: 4496 - DNA, 648 bp, Homo sapiens
  misc_feature: GYAE6OF02I22AM.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggagggccaccatcaactgcaagtccagccagagtgtttacacaggtaccaacaataagaattacttcgcttaggtaccagcaagaaaccgaggacagcctacctaagtcgctctatttacgtggctacgtccgtacccgggacggtcccggggtccctgaccgtattacgaggcggcgacggcggtctagagacgtagtactttcactctacaccatcgagccacgcctgcgaggctaggaagagtggtacgggtattaagttttactacgttcgtacgtagtacgttaagttagtttaagtaacgttacgttacccttacggtaacgtttccgggtttaccggggaccggggttaaccaacggtacggttaggaacgtacttaaccggaaaccgttacggtacggtacggtacgtaccggtacccacgtacgtttccgttacgttacctttacctccgtttaccccgg

SEQ ID NO: 4497 - DNA, 510 bp, Homo sapiens
  misc_feature: GYAE6OF02G82TB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcctacccgggagtcccggggtccctgaccgattcagcggcagcgggtctgagacagatttcactctcaccatcagcagcctgcaggctgaagatgtggctagtttattactgtcagcagtattatagtagtcctcagtacgtttgggaccggggtacaacgcgtaggagtatacgaacgaactgtaggctgacacatctgtcttactatccc

SEQ ID NO: 4498 - DNA, 787 bp, Homo sapiens
  misc_feature: GYAE6OF02FYCEP.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggcccaccatcaactgcaagtccagccagtagttgtttacacgacgtaccaacaataagtaatttacttcgtcgttcggtaccagacaagaaaccgaggacacgcctaccgtaagttcgactctactttacgtcgggacacgtcccggtaacccggggtaccgggttcccggggtcccctacggtaaccggtagtttccggacggtccggccgtagggtccgggtcgtacgggacgaccgtaagtactttcgaaccttcctaccaaccgtaactccgacgtcccgaacgtccctaggtaccgacgggtcgtaacggtaaagtcggttacgggtaccggttacgtttaacgtttttaacgttacgttacggtacgtaacggtaccgtttaagtttaacgttagtttaacggttaaccgtttcctacggttttaaaccggtttaccggggttttaccgggggacccgggggtaaacctacgggtacggttaacgggaaccggttactaaacccggtaaacggttaccggtcgggttacggtcccgttaccgaacccgttaccgttacgttacccgtttgttacccggttacctacccggtttcccccg

SEQ ID NO: 4499 - DNA, 571 bp, Homo sapiens
  misc_feature: GYAE6OF02IUJX5.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctctatttacgtgggcatccgtacccgggagtcccggggtccctggaccgattcacgcggcaggcgggtctggagaccgagtactttcgacttctacaccatccagccagcctgacgaggctagaagagtggtgtactagtttatacgtgtacagctagttatattagtacgtcctagtagtacgttttcgggaccggggtactaggtcgtgggtagactaacgtaaacgtacgtaggtcggacgtcgaccgtacctacttccgtcgttctttaccttcgtttaccccg

SEQ ID NO: 4500 - DNA, 831 bp, Homo sapiens
  misc_feature: GYAE6OF02H3735.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgctacgggacatcgtgatgacccagtctccagactccctggctgtgtctcgtgggcgaggagggccaccatcaactgacaagtccagaccagtagttgttttacacgtaggtaccaaacaaagtaagtaacttacttcgtcgttacggtaacctacgacaaacgaaaccgaggtaaccacgcctacgttaagttgtactcttattacgtgggactacgtacccgtacccggggtacggttcccggggtacccgtacgaccgtacgttcgacggcggtacgacggtcggtcgtaggtaacgacgtagtacttttacaccgttcctaccgtaccaactaccgaacgccgtaacgccgttacggaacccgtggggttaccctaagggaaacggttcgttacgggtaaccgggttactttaacggttttttaaacgtaccggttacgtttaacgtacggaactttaaagtttaacgtaacggttttaacgttacccgttaacccgtttacgggttaaacgggtttttacccgggttttaacccgggggggaaccccggggttaacccaaagggttaccggtaaggggttaacgtaaccgtttaaacggaaaaccccggttggtttaaccggggtccggtaaaccccttaggtaaccctaaacccgggttccgtttcctttacccggttaccctttacgtttacccgtttaccccccgg

SEQ ID NO: 4501 - DNA, 573 bp, Homo sapiens
  misc_feature: GYAE6OF02IGI3A.39.31.C09.1.454.CMB.1.raw
  modified_base (219)..(219): a, c, t, g, unknown or other
  misc_feature (219)..(219): n is a, c, g, or t
  modified_base (356)..(356): a, c, t, g, unknown or other
  misc_feature (356)..(356): n is a, c, g, or t
  modified_base (425)..(425): a, c, t, g, unknown or other
  misc_feature (425)..(425): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacncaggtccaacaataagaattacttcgcttaggtaccagcaagaaaccaggacagcctcctaagttgctcatttacgtgggctatccgtacccgggaggtcccggggtcctgaccgatcagcgcagcggtctgagacngtatttcactctcaccatcagcagcctgcaggctagaatagtgtgctagtttatcttgtcagtctagtntaatgtagtcctgtacgttacgttttacgggaccgggggtaaccaacggtcgtacgggtagtacgtacgtaaaacggtaacgtaggtacggacgttacgaacccacctacgtttccgttacgtttacctttaccgtactttacccccg

SEQ ID NO: 4502 - DNA, 586 bp, Homo sapiens
  misc_feature: GYAE6OF02IDPUQ.39.31.C09.1.454.CMB.1.raw
  modified_base (408)..(408): a, c, t, g, unknown or other
  misc_feature (408)..(408): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttacacgacggtacaaacaataagaattacttcgcttggtaccagacaagaaaccaggacaagcctacctaagttgctactatttactgggcacgtcgtacccgggagtcccgggtcctgaccgtatcagccggcaggcgggtactgagacagtactttcacgtactcacctatcagcagcctgcgaggctagaanagtgcgtactagtttattacgtgtacgagtagtaagttataagttagttacgtcctacgtagttaccggtttcgggaaccgggggtacctaaggtcgtaggatacgtaacaaacggtaacttggaggtccttacggaccaccgtacgttacgttcgtttacttaccgtactttccccg

SEQ ID NO: 4503 - DNA, 665 bp, Homo sapiens
  misc_feature: GYAE6OF02I5PVS.39.31.C09.1.454.CMB.1.raw
  modified_base (304)..(304): a, c, t, g, unknown or other
  misc_feature (304)..(304): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttcgttttacacaggtaccaacaaataaagtaattacttcgcttggtaccagcaagaaaccaggacagcctacctaagttgctactatttacgnggcacgtccgtacccggggtacggtcccgggtcccgtcgaccgtattcgacgcgggcacggtcggtctagacgacagtactttcactctaccgaacactacaacgcaacgcctcgacgacggtcgtaggaagtgttagggtacgtacttaagttttacttacgttgtaccgtagtacgtaagttatttaagtaaggttaaccgttcccttagtaaccgttttcgggttttaccgggggacccggggtaaccaacgggttcgtaacgggtagtaacgtaaccggtaaaacgtaacgttagggacggttcctacggacctaaccgtcgttaccttaggttacccttcgtacccgtttaccccg

SEQ ID NO: 4504 - DNA, 734 bp, Homo sapiens
  misc_feature: GYAE6OF02I0UVX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatccaactcgcaagtccagccagagtgttttacacaggtccaacaataagaattacttcgcttgtaccagacagaaaccaggacacgcctcctaagttcgctactatttacgtgggctactccgtacccgggacggtcccggggtcccctacggacccgtagttcgacggccggacgacggcggttctggaacggacaggtaactttacgaccttctaccacctacgtcctaaaggccgtaacgcccgtacgaccgtaacgggaccgttaacggaagtaacgttcggtagggtacctaagggttttaacttaccgttagtacgtacgtaccgttagttaaacgtttaagttaacggtaacgtttacccgttaccgtaacggtttaccggtttttaccggggaacccgggggttaacccgtaacgggtaccgggttaggtaacggtacttaaccggaaaaccggttacggttaacgtcgggtaccgtaccggtacccttaaccgtaccttaccgttaccggttacccgtttacctaccgtttacccccg

SEQ ID NO: 4505 - DNA, 621 bp, Homo sapiens
  misc_feature: GYAE6OF02F49CS.39.31.C09.1.454.CMB.1.raw
  modified_base (221)..(221): a, c, t, g, unknown or other
  misc_feature (221)..(221): n is a, c, g, or t
  modified_base (334)..(334): a, c, t, g, unknown or other
  misc_feature (334)..(334): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctggggcgaggagggccacgatcaactgcaagtccagccggagttgttttanacaactccaagaataagagttcttagcttggtaccagcaagaaaccacgacagcctcctaagctgctcgttactggccctcgtacccgggtatcccggggtcctagaaccgtnttcgaggtcggcgggtcggggtctaggggacaggtacttcactcgtacaccatcagccagccgtggccgggactggaagtagtggtcgggtcggtttatacgtgtacagtctagttattatgttacctccgtactactaggtttgaccgacggggtaccaaggtcgttagggacgtacgtccgactaacgggtaccttcggtggtaccgtcggaaccgtacccgtaacgttccgttacgttcccttaccgttaccgttccccgtttacccccgccttaaccttccgg

SEQ ID NO: 4506 - DNA, 695 bp, Homo sapiens
  misc_feature: GYAE6OF02HALEE.39.31.C09.1.454.CMB.1.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagttgctcatttacngggcatcctacccgggagtccggggtccctgaccgattcagcggcacggcggtctgagacagactttcgacgttctaccgaacctatccgaagcaacggcccgtacgccgtaacgggccgttaggaaacgtacgtgggttacggacgttaacggtttttacttacgttacggtccgtaacgcctaacggtttaagtttaagttaacggtttaacgttacccgttacggtaacgtttaccgggttttttacggggacccggggggttaaaccgtaaacggtaccgttacggggtaaggtaccgtaaccgtaaaacccggtaacggttacggttacgggtaccgttacggtaccctaacccggtacgttcccgttacggtttaccctttaccgtaccgtttaccccg

SEQ ID NO: 4507 - DNA, 591 bp, Homo sapiens
  misc_feature: GYAE6OF02JGPB8.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatcctacccgggatccggggtccctgaccgattcagcggcaggcggtctgagacagtatttcactctcaccatcagcagcctagcgacggcttaggaagcgtggtaggactagtttattacgtgtcgagtcaagttatagttagtacgttcctacgtacgttacgttttcggggacccgggggtaacaacggtaccgtagggagtacgtaaccgaaacggtaacggttacgtagggtaccgtaggtaccacccgtaacggttaccttacgggtactttaccgtaactttaccccg

SEQ ID NO: 4508 - DNA, 773 bp, Homo sapiens
  misc_feature: GYAE6OF02ITKI5.39.31.C09.1.454.CMB.1.raw
  modified_base (118)..(118): a, c, t, g, unknown or other
  misc_feature (118)..(118): n is a, c, g, or t
  modified_base (721)..(721): a, c, t, g, unknown or other
  misc_feature (721)..(721): n is a, c, g, or t
tcagtcgcactagtcacgaccggtgctcgatttagacgtctcatcaaggaaggaaggggcagcaagatggtgttgcagacccaggtcttcatttctctgttgctctggatctctggtncgtacgggacatcgtgatgacccagtctccagacctccctggcctgtgtctctgggcgaggacgggccaccgatactaactcgcaacgtccgagccgagtacgttgttttaacacgtaggtaccaacaagtaaagtaattacttcgactttggtaccaggacaacgaaaccaggaccacgtcccttactaacgttcgcttaccgtaacttttacgcgggactaacttccggtaacccgggtacggttcccggggtaaccctcggtaacccggtagtttaccgaccggacggtaccgtaacgggtccggggttacccgttagggaacgtaacccgtaaggttaccgttttaccgtaacttcccgtaaccctaccgtaaacgttccgaaccggttacaaccgttccgttaacgccgtaaacgggacccgtttaaggaaaccgttgttaacggtaccggtaagtttaaccggttttaacgttaaccgttcggtaactacggtacgttaacgttattacgtaagttaccgttaccacggttaacgttcggtttacggggacccggtaacgtacgtacggagtaacgtcgtaacgtaaacgacggttnaccggttacgtcacgtaccctagaccgtttcgactttaccgactttccccgg

SEQ ID NO: 4509 - DNA, 636 bp, Homo sapiens
  misc_feature: GYAE6OF02H0UXG.39.31.C09.1.454.CMB.1.raw
  modified_base (311)..(311): a, c, t, g, unknown or other
  misc_feature (311)..(311): n is a, c, g, or t
  modified_base (493)..(493): a, c, t, g, unknown or other
  misc_feature (493)..(493): n is a, c, g, or t
  modified_base (607)..(607): a, c, t, g, unknown or other
  misc_feature (607)..(607): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctggctgtgtctcgtggcgagaggccacatcaactgacaagtccagccagagttcgtttacacgtacggtaccaaacaataagaacttacttcgtcttacggtaccagacaacgaaaccgaggacacgcctactaagttcgctactatttcgnggactacgtccgaccggtacgtacccggtcctacgaccgtactcgacggtcggcgaggtccggtactcggacgacgtagtacgtttcacgtcctcaacctactaccgaacgtcgaacgtcctagccgtacggtacgttaggaacgtagttcggtaggtaccttagttttacttacgtcgtanacgtacgttaagtaatagtagtaccgttctacgtacggttacggtttacgggaccgggtaacacgtacgtaggtacacgtacgaacggtacgtgtacggtactacgccgtactnttacgtacgtttactacgtaccttacccg

SEQ ID NO: 4510 - DNA, 592 bp, Homo sapiens
  misc_feature: GYAE6OF02GC7KH.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctacctaagttgctctatttacgngggcatccgtacccgggagtcccggggtccctggaccgtattcgagcggcaggccgggtctgagacagtatttcactctcaccatcagcacgcctgcgaggctaggaagagtggtacgtacttagttttacgtacttgtaccgagtcgttaagttattagtagttacgtccttacgtacgtttacggtttcggggaccggggtaaccaggtcgtaggtacgtagtaacgaaaccggtaacgttggtacgggtacttacggaccacctagttccttacggttacttaccacgtttcccc

SEQ ID NO: 4511 - DNA, 582 bp, Homo sapiens
  misc_feature: GYAE6OF02GERSO.39.31.C09.1.454.CMB.1.raw
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaacaataaagaattacttcgcttggtaccagcagaaaccaggacagcctctaagtnctcatttacgngggcatccgaccgggagtccgggtcctgaccgattcagcggcaggcggtctgacgacagtactttcactctacaacatcagccacgcctcgcacggctagaagtagtgtggtctagtttattacgttcgtacagtctaagtatttaagtagtacgtaccttacgtacggttacgttttcggggacccggggtaacgaacggtcgtaggacgtagtaaccgaaacggtaacgttaggtacggtacgtacgaccgtacctacgttcgttcgttaccttactaccgttcccg

SEQ ID NO: 4512 - DNA, 640 bp, Homo sapiens
  misc_feature: GYAE6OF02JXYNH.39.31.C09.1.454.CMB.1.raw
  modified_base (306)..(306): a, c, t, g, unknown or other
  misc_feature (306)..(306): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataaagtaattacttcgacttaggtaccagcaagaaaccaggacagaccctacctaagttcgctactatttaacgngggcctaagtccgtaacccgggagttccccggggacctgacccgtattccgaggtccggcaagggtccgggtctaggacgtacacggtattttaccactctaccaaccttaacaccgaagcctaacggtccctcgactacggcctagaaagtcgtggtacgtactaagtttactaacgttcgacaacggtacttaaggttatttaacgtagtacgtaccctgtaacgttacggtttacgggaccgggttaaccaagtcgtaggtactacgtaacgtaaacgtcgtaggttcgtacgtacacccgtagtctacgttcgtacttccgtattccccg

SEQ ID NO: 4513 - DNA, 766 bp, Homo sapiens
  misc_feature: GYAE6OF02F5R9I.39.31.C09.1.454.CMB.1.raw
  modified_base (236)..(236): a, c, t, g, unknown or other
  misc_feature (236)..(236): n is a, c, g, or t
  modified_base (323)..(323): a, c, t, g, unknown or other
  misc_feature (323)..(323): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctcgtgggcgagagggccaccatcaactgacaagtccagccaggagttgtttacacgacggtaccaaanaaataaagaatttaccttcgctttggtaaccaggacaacgaaacctatacgaacacgcccttacgtaagttgactctacttttacgnggacacgttccgtacccggggtaggttccccgggtccctacggaaccgtattcgacggccggacgtaggtccgggttctcgggaacgtacgtacggttaacttttccaacgttccgtacaacccgtatacgacgacgtacggtcccgtaggaccgtacgggactaaggtaaaggtacgttacgggttacggtaccgtttaagttttaaaccgttacgttacggttactaacgggtaaccttaaggtttaacttaaagtttacgttaacgttccgtaacgttacgggttaccggttttacgggggaacccgggtaaaccgtaacgggtacggttacgggacgttaacgtaaaccggtaaaacggtaaccggttacgggttccggtaaccgttaccggtaaccgtaaccgttaccgttacgtttccggttaccttccgttacccc

SEQ ID NO: 4514 - DNA, 611 bp, Homo sapiens
  misc_feature: GYAE6OF02HE2GZ.39.31.C09.1.454.CMB.1.raw
  modified_base (295)..(295): a, c, t, g, unknown or other
  misc_feature (295)..(295): n is a, c, g, or t
  modified_base (340)..(340): a, c, t, g, unknown or other
  misc_feature (340)..(340): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttacacaggtccaaacaataagaattacttcgcttggtaccagcaagaaaccaggacagcctctaagttgctctatttacgnggctagtccgtacccggggagtcccggggtcctggaccgtattcngcggcaggcggtctgagacagtactttcactctacaccatccagccacgcctcgcaggacagaacgtacgtggtcggtacgttaacgtttagttaccgttatcgacgtactagttaatttaacgtagttacgttacctacgtacgttacggtttttacggggacccggggtaactacggaccgtggaacggtactaacggaaacggtaacgtcgggttacggtcgtacgaccgtaacctcttaccgtacgttaccttcgtacctttccccg

SEQ ID NO: 4515 - DNA, 532 bp, Homo sapiens
  misc_feature: GYAE6OF02GSD89.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctctatttactgggcatctacccgggagtccgggtcctgaccgattcagcggcagcggtctgagacagatttcactctcacatcagcagcctgcaggctgaagtatgtcggactagtttattacgtgtcagctagttattatagttacgtcctacgtagttacgtttcgggaccggggtaacaagtcgtaggagtactacgaaacgtaacgtggtaggctacgacactacgttcttgtcttctattccccg

SEQ ID NO: 4516 - DNA, 575 bp, Homo sapiens
  misc_feature: GYAE6OF02GEMA2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacagggacatcgtgatgacccagtctccagactccctggctgtgtctctgggcgagagggccaccatcaactgcaagtccagccagagtgtttacacaggtccaacaataagaattacttcgcttggtaccagcaagaaaccaggacacgcctacctaagttgctctatttacgtgggcatccgtacccgggagtccggggtcctgaccgattcagcggcaggcggtctgagacagtatttcactctcaccatcagcacgcctgcgaggctagaagatggtcggtcttagtttattacgtgtacagtctagttaattagttaacgttacgttcctacgtagttaccgtttttcggggaccggggtaccgtaacggtcgtaggacgtagtaaccgaaacggtaacgttggtacggtcgttacgactaccgtacgttactcgttaccttctacccg

SEQ ID NO: 4517 - DNA, 593 bp, Homo sapiens
  misc_feature: GYAE6OF02GWLKQ.39.31.C09.1.454.CMB.1.raw
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
  modified_base (571)..(571): a, c, t, g, unknown or other
  misc_feature (571)..(571): n is a, c, g, or t
  modified_base (578)..(578): a, c, t, g, unknown or other
  misc_feature (578)..(578): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttacacaggtaccaaacaataagaattactcgcttggtaccagcaagaaaccaggacagcctacctaagttgctctatttacgngggcactccgtacccggggagtcccggggtcctgaccgtnttcgaggcggcaggccgggtctggagacagtactttcacctctaccaccataccgacgtaccacgtccctacggacgtacggcgtaaggaacgtagttggtacggtcttaagttttactacgttgtacgagtactagttaattatacgttactcctcgtacgttacgtttcggggaccgggtaccagtcgtaggatacgtacgaaacgtacgttggcgtacgtgacctacgtntccgttnttactctacttcccg

SEQ ID NO: 4518 - DNA, 567 bp, Homo sapiens
  misc_feature: GYAE6OF02IGMV9.39.31.C09.1.454.CMB.1.raw
  modified_base (314)..(314): a, c, t, g, unknown or other
  misc_feature (314)..(314): n is a, c, g, or t
  modified_base (357)..(357): a, c, t, g, unknown or other
  misc_feature (357)..(357): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttacactaggtccaaacaataagaattactcgcttggtaccagcagaaaccaggacagcctactaagttgctctatttacgtggctatccgtacccggggnggtcccggggtcctgaccgtattcgagtccggcaggcgggtcngagacagatttcactctcaccatcagcagcctgcgaggctagaagngtgtgatagtttattactgtnagtacgtagttatagtagtactcctatagttacgttttcgggaccgggtacaggtacgtggagtacgtaaccgtaaacgtacgtaggtacggcgttacgtacctaccgtaacttcttacggttctttaccgtatttaccccgg

SEQ ID NO: 4519 - DNA, 599 bp, Homo sapiens
  misc_feature: GYAE6OF02HYQPP.39.31.C09.1.454.CMB.1.raw
  modified_base (302)..(302): a, c, t, g, unknown or other
  misc_feature (302)..(302): n is a, c, g, or t
  modified_base (455)..(455): a, c, t, g, unknown or other
  misc_feature (455)..(455): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacgggacatcgtgatgacccagtctccagacctccctggctgtgtctctggcgagaggccacatcaactgcaagtccagccagagttgtttacacaggtaccaaacaataagaacttactcgtcttggacagcaacgaaaccaggaactacgccttacctaaagttgctactaactttacgnggctactaccgtacccgggacgtcccgggtccctacgacgaacttcgacgcggcaggcggtctaggagactagactttacacttcgtacaaccaatcagtcacgctagccgaggtctaagaagctaggtcgacgttaagtttataacgtcgtnaacggactagttattaatacgtaacgttccctagtagtaccgttttcgggaccggaccaagtcgtaggaagacttaccgaaagaccgttggtaacggccttaagaacctaacgtacgttcttacgtacttccgaatttcccccg

SEQ ID NO: 4520 - DNA, 729 bp, Homo sapiens
  misc_feature: GYAE6OF02JNAC5.39.31.C09.1.454.CMB.1.raw
  modified_base (535)..(535): a, c, t, g, unknown or other
  misc_feature (535)..(535): n is a, c, g, or t
  modified_base (563)..(563): a, c, t, g, unknown or other
  misc_feature (563)..(563): n is a, c, g, or t
tcagtcgcactagtcacgaccggtgctcgatttagacgtctcatcaaggaaggaagggcagcaagatacggtgttgcagacccaggtcttcatttctctgttgctctcgatctctggtgcgtacgggacagtcgtgatgtaccagtctccagactcctgcgtgtcgtctctgggcgtagacgggccaccgtatcaaacgtcgctaacggtccgacgtccgaggagttacggttttaacaccgtagggttacccaaacgaaagtaacgaaagttacgttccgtcgttacggtaaccaaggctaaacgaaaaccgtaggaacacggtcctaacgtaaacgtttcgcttactaagtttaaccgtgggctaacgtccgtacccggggtacggttacccggggtccctacggaccgtcgttaccgtacggcgggtacgacgggtccggggtctacggtaacgacgaacggttacgtttacgaacctgtacctaccgtactcgaacgcacggtccgtaggacgaggcgtaagaacaggtgnggtactacgttacgttaggcgttaacgngaccgtagtaacttagtagttacgtacctacgacgtttcggttacgggccgggttaacgaacgttacgtaggtaaccgtataaccggtaacgaacggttggtacggtaacgtaccggactaacccgggttagtccgtttaccggtactttcccgaaggtttccccg

SEQ ID NO: 4521 - DNA, 539 bp, Homo sapiens
  misc_feature: GYAE6OF02FHOHT.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagttgctcatttactggcatcgtacccggagtccggggtcctgaccgattcagcggcagcggtctgagacagatttcactctcaccatcagcagcctgcaggctagaagagtgtcggactagtttattacgttgtacagctagttattaatagttagtcctactagtacgttttacgggccggggtaccgaagcgtaggagtactacgaacgtaacgtggtcggtcgtcgacgacctacgtccgttgtccttacgtacttcccg

SEQ ID NO: 4522 - DNA, 610 bp, Homo sapiens
  misc_feature: GYAE6OF02GBZN7.39.31.C09.1.454.CMB.1.raw
  modified_base (414)..(414): a, c, t, g, unknown or other
  misc_feature (414)..(414): n is a, c, g, or t
  modified_base (581)..(581): a, c, t, g, unknown or other
  misc_feature (581)..(581): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggacgggccaccatcaactgcaagtccagccagagttgttttacacaggtaccaacaataagaattacttcgcttggtaccagcaagaaaccaggacagcctacctaaagttcgctctaatttacgtgggcattccgacccggggtacggtcccggggtcctacgacccgtattcgaggccggcgaggcggtctaggagacaggtactttcactctacaccatcagcacgtctggacnggctagaagtgtggtggacttacgtttattactgtcgagtccgtaagttaactttagttaaggtacgttacctacgtagggttacgttttcgggggacccggggtaaccaggccgttaggagtacgtaacggaaaccggtacgttaggtcggataccgcgtaacccngttccgtcgttacttccgcttttaccccg

SEQ ID NO: 4523 - DNA, 575 bp, Homo sapiens
  misc_feature: GYAE6OF02GK4NJ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctctatttactgggcatcgtacccgggagtcccggggtcctgaccgattcagcggcaggcgggtctgagacagtatttcactctcaccatcagcagcctgcaggctaggaagtatgtggctagtttacttactgtcagtcaagttattagtagtacgtaccttacagttaccgttttcggggcccgggggtaaccaacggtcgtagggaacgtacgtaaccgaaacggtaacttagggtacggtcgtcggtaccctacctacgttccgttacgttcctttaccagtttcccccg

SEQ ID NO: 4524 - DNA, 774 bp, Homo sapiens
  misc_feature: GYAE6OF02JMQ5R.39.31.C09.1.454.CMB.1.raw
  modified_base (697)..(697): a, c, t, g, unknown or other
  misc_feature (697)..(697): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacgggacatcgtgatgacccagtctccagactccctggctgtgtctctgggcgagagggccaccgatccaactgcaagtccagccagagtgtttacacaggtccaacaataagaattacttacgcttgtaccagacagaaaccaggacagcctaccgtaagttcgctctatttacgtgggactagtaccgtacccggggtagtcccgggggttcccctcggtaacccggtactttaccgaccggtccgggaccgtaacgggtccggggttactcggtaacggaaccgtaacggttaagttttcccgaaaccgttccgtacccctaaacccgtaactttcccgaaacggttccccgaacggtcccccgtttacggacccggtaaccggggtccggttaaacgggtaaacccggtaaggttacgggtttcgggtaccgtttaacggttttacgttttaaccgttcggttaccgtaacggtacccgttaagttaaccgtttaagttacggtttaaacgtcccgttacgtacgttaaccggttttcggggacccggggtaacaaggtacccgtaggtanacgttaacgaaaccgttaaccgtaggttcggacttccggctacccgtacggtcttacggttcttactacgtttcccg

SEQ ID NO: 4525 - DNA, 660 bp, Homo sapiens
  misc_feature: GYAE6OF02JZZED.39.31.C09.1.454.CMB.1.raw
  modified_base (432)..(432): a, c, t, g, unknown or other
  misc_feature (432)..(432): n is a, c, g, or t
  modified_base (461)..(461): a, c, t, g, unknown or other
  misc_feature (461)..(461): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgaccagtctccagactccctggctgtgtctcgtgggcgagagggccaccatcaactgcaagtccagccagtagtcgtttaccacgaggtccaaacaataagtaacttacttcgcttaggtaccagtacaagaaccaggacacgcctaccgtaagttcgctactatttacgcgggactacgtaccgtaccggggtacgtccgggtcctcgaaccgtagttaccgaggcggtacgacggtcgggtactcggacgacacgttacttcaactctacgactatacgacgtacagtaccgngtacgaggcttaggaagtacgtaggtcgngttacgttttagtacctgtcgtaagcgtaagttattaaggtacgttacgttacctacgtaacgggttacggtttacggggaacccggggtactacggaagtcgggtaacgtacgtacggtaaaaccggtgtacgggttcggacccgttacggtactaccccgtagttccgttacggttacccttcgtacccgtttaccc

SEQ ID NO: 4526 - DNA, 596 bp, Homo sapiens
  misc_feature: GYAE6OF02HKPXZ.39.31.C09.1.454.CMB.1.raw
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaaataagtaattacttcgcttggtaccagcaagaaaccaggacacgcctacctaagttgctctatttactgggcagtccgtacccgggtagtccgggtccctgaccgnttcagcgngacgcggtctgagacagtatttcactctacactatcagcacgcctgacaggctagaagatggtacgcttaagtttattacgtgtacacgtactaagttattagttagtacgttacctacgtacgttacgtttacggggaccggggtaacctacggtcgtagggacgacttaccggtaaacggtaacgttcggtacggtcgttacgaccaaccgtattccggttacgtttaccttctacccgtttccccg

SEQ ID NO: 4527 - DNA, 930 bp, Homo sapiens
  misc_feature: GYAE6OF02FZ5V5.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcccgtacggggacatcgtgatgacccagtctccagacctccctggctgtgtctcgtgggcgaggacgggccaccataccaactgacaacgtccagccaggtagttcgttttacaccacggtaccaaacgaataaagtaacttaccttcgtctttacggtaaccaggaccaacgaaaaccgagggacctaacggcccctaccttaaggttcgaccttacgtaacttttaccggtggggacctacgttacccggtacccggggtacggttccccgggggtcccttacggacccgttacgttaccgagggcccggtaccgacgggtccgggggtcctagggaacgtaaccggtagtttaacgtttccccgaacgtttaccgtacccgtaaacctaacgtacccggaacggacccgtaacggtccccggttacggtacccgggtacgggaccgttaaagggtaaaaccgggtaggtttaccgggtacggggttaacgtttaacgggtttttaaccttttaccggttacggttacgaaccggttaaccgtttaagggttttaaacttttaaggttaacggttttaaccgggtaccctttaacccgggttaaacgggttttacccgggttttaccggggggtaacccggggggttaaaccctaacggggttaaccgggtaaggggtaaccgtaacgttaaaccggtaaaaccgggttaaccggttacgggttacggggtacccttaacgggtaaccccgttaacgttaccgtttaccggttacggtttacccctttaccggtaccgtttacccccggg

SEQ ID NO: 4528 - DNA, 733 bp, Homo sapiens
  misc_feature: GYAE6OF02HPZD2.39.31.C09.1.454.CMB.1.raw
  modified_base (237)..(237): a, c, t, g, unknown or other
  misc_feature (237)..(237): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctggctgtgtctcgtgggcgagacgggccaccatcaactgacaagtccagccagagttgtttacacgacggtaccaaanaataagtaattactcgacttggtaaccagtacaacgaaaaccaggaacacgtcccttacgtaaagtttcgaccttactagttttaaccgcgggactacgtaccggtaaccccggggtcggttccccgggggtaccctcgggtaacccgtaagttaccggacgggtaccggtacgtaacgggttccgggttactcggaaacgaccgtaaggttacttttaccgaactccgtaactaccgtactacgacgtacgacgtcctaggcgtaacggctagaacgtagttgtacggacttaagttttactacggtacgtacaggtctaaagttcttaagtacgtacgtacctacgtaggttaccggtttacgggaccgggtaaactaggacgtacgggtaacgacgtaaccggtaaaccggttaacggtaggtacggtacgttaaccggaaccttaccgtagttacccgtttaacggtttacttaccgtacgtttaccccccg

SEQ ID NO: 4529 - DNA, 651 bp, Homo sapiens
  misc_feature: GYAE6OF02GDSYF.39.31.C09.1.454.CMB.1.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctctaagtgctcatttacgnggcatccgtacccgggagtcccgggtcctgaccgtattcgagcggcacggcgggtctagacgacgagtactttcacgttctacaacctactcgacgtccacgtccctacggcgaggtctaggaagtacgttggtcgggtacttagttttaacttacgttgtactagtacgtaagttatttaagttaaggttacgttaccgtacgtaacggttacggttttccggggacccgggggtaaccaacggtacgtagggaagtacgtaaccggtaaaccggtaacgttacgggtacgggtacgttaccgtacccgtaacccgtacgtttccgttaccgtttcccgtttacctaccgtttacccccg

SEQ ID NO: 4530 - DNA, 614 bp, Homo sapiens
  misc_feature: GYAE6OF02G042W.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttcgtttacactaggtaccaaacaataagtaattacttcgcttggtaccagcaagaaaccaggacacgcctacctaagtcgctctattacgtggcactccgtacccgggacggtcccgggtccctcgtaccgtattcgacgccggacgaggtcggtctaggacgacacgtatttcactctcaccatcagcacgcctgcgaggctagaagtgtgtacggtacttagtttactctgtacagtactagttatagtagttacgtccttaggtacgttacgtttcggggaccggtaaccgagtacgtagggaacgtactaaccggtaaacgtacggttacggtacggaccgttacgaccgtacccgttagttcccgttaacgtttcccttaccgtccgtttacccccgg

SEQ ID NO: 4531 - DNA, 590 bp, Homo sapiens
  misc_feature: GYAE6OF02HY9PW.39.31.C09.1.454.CMB.1.raw
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagaggcaccatcaactgcaagtccagccagagtgttttacacaggtaccaaacaataagaattactcgcttaggaccagcaagaaacctaggacagcctacctaagttnactatattacnggcactctaccggagtccgggtccctgtaccgaattcgagcggcgagtccgggtancgganagtatactttcactcncaactancacgctacgcgacgacgtacggtactagaacgtagtaggtcgtagttagtttaattacgtgttacagagtaagttattaagtacggttactacctacgtacgttacggttacgggacggggtaacgtaacgtacggtacgtaagaacgtaacgtaaacggtaacttcggagtacgacgtaccgtactacgtcctacgttcttacgtccgtac

SEQ ID NO: 4532 - DNA, 558 bp, Homo sapiens
  misc_feature: GYAE6OF02IKVW3.39.31.C09.1.454.CMB.1.raw
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaaacaataagaattacttcgcttggtaccagcagaaaccaggacagcctcctaaagttgctcatttactggcactaccgtacccgggagtccggggtcctgaccgattcagcggcaggcggtctgagacagatttcactctacaccatcagcacgcctgcaggctagaagntgtggacttagttattacngtcagtactagttatacgtagtactctacgagttacgtttacgggccggggtaacctagtcgtaggacgtacgtacgaaaccggtagtacggtcggtactcgacctacctaacgttcgttacgttactttaccgagttccccg

SEQ ID NO: 4533 - DNA, 589 bp, Homo sapiens
  misc_feature: GYAE6OF02FYYB5.39.31.C09.1.454.CMB.1.raw
tcagtcgcactagtcacgaccggtgctcgatttagacgtctcatcaaggaaggaaggggcagcaagatggtgttgcagacccaggtcttcatttcctctgttgctctggatctctggtgcctacggggacatcgtgatgacccagtctccagactccctggctgtgtctctgggcgagaggccaccatcaactgcaagtccagccagagttgtttacacaggtaccaacaataagaattacttcgcttggtaccagcagaaaccaggacagcctacctaagttgctctatttacgtgggcagtccgtacccgggagtcccggggtccctggaccgattcgaggcggcacggccgggtctagagacagtactttcgactctcaccatcagcagcctgcaggcagaagagtgtgctagtttattactgtcgagtctaagttatttagtacgttacgtaccttagtacgttacggttttacggggacccggggtaacctaggtcgtagggaacgtacgtaaccgaaacgtacgttggtacgggtcctacgacctaccgtagttccgttacgttccttactacctttaccccg

SEQ ID NO: 4534 - DNA, 675 bp, Homo sapiens
  misc_feature: GYAE6OF02I25KL.39.31.C09.1.454.CMB.1.raw
  modified_base (347)..(347): a, c, t, g, unknown or other
  misc_feature (347)..(347): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatacaactgcaagtccagccagagttgtttacacaggtaccaaacaataagaattactcgtcttggtaccagcaagaaaccaggacacgcctacctaagttgactactatttacgtgggcacgtaccgtacccggggacggtccggggtccctgaccgtnttacaggcggcacggcgggtctgagacgagtatttccacttctacactcgagcacgcctgacgaggtactagaaagtagttaggtaggtactaagttttaacttacgtgttacgtagtactaagttattagtacgttacgttaccctacgtaacgtttaccgggttttacggggacccgggggtaacccgtaaggtccggtaagggtaacgtaaccgttaaccgtaaacgggtaacgttcgggtaccgggtacctacggtaacccgtaaccgttacgtttacggtaccgtttaccgtttacccgttaccgttcccgttaaccccccgg

SEQ ID NO: 4535 - DNA, 594 bp, Homo sapiens
  misc_feature: GYAE6OF02GC39M.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaacaataagaattactcgcttggtaccagacagaaaccaggacagcctcctaagtgctcatttactgggctatcgtacccgggtacgtcccggggttccctggacccgattcgacggtcggcacgccggggtctgacgacgagtagtttcacgtctccaacctatcagtccagtcctgcgaggacctaggaagagtggttcggacgtagtttattcgttagtaccagtcgtagtattatagtcgttacctcgtacgttacgtttcgggacccggggtacaacgtcgtagggacgtacgtacgaaacggtacttaggtacggtccgtagtaccgacctataccgttcgtaccttacgtactttacccccg

SEQ ID NO: 4536 - DNA, 702 bp, Homo sapiens
  misc_feature: GYAE6OF02FN9SJ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgacgaagtccacgccagtagttcgtttacactacggtaccaacaaataagaacttacgttcgtcttacggtaccagaccgtaacgaaaccgaggacacgcctactagttcgctactacgtttacgcggactacgtccggtaacccgggtacggttcccgggtaccctacggaccgtacgttccgaacggccgacgacggtccggtcgtacggacgtacgtacgtacgtttcaccgttcacgaactactacgacgacctacgtcctggacgacggtccgtaaggaaaccggttgtccgggttaggaccttttaacggttactttacgtcggtactaggtacgtaagtttacgtttacgtaggttacccttacgttacgtacggtttacggtttccgggggaccggtaacacggtcgtaaaggcgtaacgttaacggaaacgttacgtcgggtagccgttacgacctaccggtacttccgtttacgtacctttaccgactttacccccgg

SEQ ID NO: 4537 - DNA, 578 bp, Homo sapiens
  misc_feature: GYAE6OF02FGIJW.39.31.C09.1.454.CMB.1.raw
  modified_base (332)..(332): a, c, t, g, unknown or other
  misc_feature (332)..(332): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctctaagttgctcatttactggcatctacccggagtccggggtcctgaccgtattcagcgnaggcggtctgagacagtatttcactctcaccatcagcacgcctgcgaggctaggaagagtgtggctagtttagttactgtcagctagttattagtagttacgtcctacgtagttaccgttttcgggacccgggggtaaccaacggtccgtagggtaacgtacgtaaccgtaaacggtaactagggtacgggtacttacgaccgtaaccctacgttccgttacggttcctttacgtacgtttccccg

SEQ ID NO: 4538 - DNA, 605 bp, Homo sapiens
  misc_feature: GYAE6OF02JWBZV.39.31.C09.1.454.CMB.1.raw
  modified_base (313)..(313): a, c, t, g, unknown or other
  misc_feature (313)..(313): n is a, c, g, or t
  modified_base (419)..(419): a, c, t, g, unknown or other
  misc_feature (419)..(419): n is a, c, g, or t
tcagtcgcactagtcacgaccggtgctcgatttagacgtctcatcaaggaaggaaggggcagcaagatggtgttgcagacccaggtcttcatttctctgttgctctgatctctggtgcctacggggacatcgtgatgacccagtctccagactccctggctgtgtctctgggcgagagggccaccatcaactgcaagtccagaccagagttagttttacactaggtaccaacgaataagtaacttacgttcgctttacgtacctagcaacgaaaaccaggtacacgacctacctaagtcgcctctatttacgngggcaacgtccgtaacccgggtgttccccggggttccctacgacccggattcgagccggacacggcggtcgtgacgacagtacttcactctcaccatcagcagccngcgacgtcgtcgaagagtgaggtactagttacgttagttcgtacgtacgacgtactagttaactagttacgtacctcgttaacgtacggttttcgggaccgggtaacgtaacgtcgtagacgataccgaacgtaacgtcgtacgtcgtacgcgtacgtactcgtacgtacttacgtacgttacccg

SEQ ID NO: 4539 - DNA, 773 bp, Homo sapiens
  misc_feature: GYAE6OF02HF6EX.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagagttgtttacacgaggtaccaacaataagaattacttcgtcttggtaccagacagaaaccaggacagcctacctaagttcgactctattttacgtgggcctactccggtacccgggtacggttccccgggggttccctcggaccgtacttccgacggtcggacgacggtcggggttctacggaacgaacgtaggttacgtttccctaccgtcccttaccaaccctaacttccgaacgccgaacgttccccgtaggaccgtacgggtaccgtaaggtaaggttaaggttgggtacgggttcctttaaaggtttttacttaccggttacgttaccgtaggtaccgttaagtttaacgtttaaggtttaacgttaccggttacccgttaaccggtaacggttttaccgggttttaccgggggtaacccgggggtaaccctaacggggtaccttagggggtaaccggtaacgtaaccggtaaacccggtaacggtttacggggtccgttacgtaccggtacctaaccgttccttaccggtttactttcctttacctaccgtttaccccg

SEQ ID NO: 4540 - DNA, 707 bp, Homo sapiens
  misc_feature: GYAE6OF02IMPVE.39.31.C09.1.454.CMB.1.raw
  modified_base (332)..(332): a, c, t, g, unknown or other
  misc_feature (332)..(332): n is a, c, g, or t
  modified_base (378)..(378): a, c, t, g, unknown or other
  misc_feature (378)..(378): n is a, c, g, or t
  modified_base (405)..(405): a, c, t, g, unknown or other
  misc_feature (405)..(405): n is a, c, g, or t
tcagtcgcactagtcacgaccggtgctcgatttagacgtctcatcaaggaaggaaggggcagcaagatggtgttgcagacccaggtcttcattctctgttgctctggatctctggtgccgtacggggacatcgtgatgacccagtcctccagacctcccgtggctgtgtctcgtgggcgagacgggcccaccatccaactgcaacgtccacgccagtagttcgttttaacacgacggtaccaaactaaataacgtaattacttcggtactttaggaacccagaccaacgaaaccgagtacacgccctacgtaagttacgctactatttacgnggtactactccggtacccgggtacgtcccggggtcctcggaccgtnttacgacggcggtacgacggtccggtntcggacgactagtactttacctacgtcttaccaactactacgtacgaccgtacgtaccgtacgccgaggaccgtaggaagtacgttggacggtacgttaaggtttacttacgtcgtacgtacgtacgtaagtattaacgttacgtaccgttaccgtagttaccgttacggtttaccggggtacccgggaaccgtacggtacgtacggtacgacggttaacgtaaccggtaacgttcgggtacggtccgtaaccggtacctccgtaacgttccgttcggttaccttaccgttacgttaccccg

SEQ ID NO: 4541 - DNA, 633 bp, Homo sapiens
  misc_feature: GYAE6OF02J1OO4.39.31.C09.1.454.CMB.1.raw
  modified_base (330)..(330): a, c, t, g, unknown or other
  misc_feature (330)..(330): n is a, c, g, or t
  modified_base (373)..(373): a, c, t, g, unknown or other
  misc_feature (373)..(373): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaacttacttcgcttggtaccagcaagaaaccaggacagcctacctaagttgctcatttacgtggcatcgtaccgggagtccggggtccctgaccgtnttcacggcgcacggtcgggtctgaacgacagtactttcactcncaccatcacgcacgcctagcacggcttaggaacgagttgtaggtccttaagttttactaacgttcgtaccagtacctaagttattacgttaacgttacggtacctcgtaacgttaccggttttacgggacccggggtaataaacggtcgttagggtaaccgtacgttaaccgtaaaaccgaacggttacggttacggtcccggttaacgccgtaaccgttcttacccgtttggtacccttttacgacccgttttaccccg

SEQ ID NO: 4542 - DNA, 779 bp, Homo sapiens
  misc_feature: GYAE6OF02GOW9G.39.31.C09.1.454.CMB.1.raw
tcagtcgcactagtcacgaccggtgctcgatttagacgtctcatcaaggaaggaagggcgagcaagatggtgttgcagacccaggtcttcatttctctgttgctctggatctctggtgcctacgggacatcgtgatgacccagtctccagactccctggctgtgtctcgtggcgagaggccacatcaactgcaagtccagccagtagttgttttacacgtacggtaccaaacaaattaacgtaaatttaccgttacgtactttacggtaaccagtacaagaaaccgaggacacgccctactaagttcgtctactactttacgcgggtactacgtaccgtacccgggtaccggttaccccggggttccctacggtaccgtagtttaccgacgggtaccggcgtaacgggtccggtacaggtacgaacgtaaggtactttacaccgtactacctaaccgtactaccgacgtccgaacgtcccgtagacgacggtaccgtaagggaagttacggtagggtacgggttactttaaaggtttacgtttacgttcgttaacgtacgtaaccggttaatttaacgtttaacttaacggttaccgtacctttaacggtaaccggttttaccgggttttacccggggtaacccggggtaaaaccgttacgggtaacgttaacggggtaacttaacggtaacctaaaaccgggttaacgttacggtcggtacctacgggtaaccctaacgttccggtacgttacgtaccgttacctaaccgttccccgg

SEQ ID NO: 4543 - DNA, 906 bp, Homo sapiens
  misc_feature: GYAE6OF02G1NMB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctccctggctgtgtctcgtgggcgaggacgggccaccatcaactgacaagtccacgccagtagttcgttttacacgaggtaccaaacaaataagtaaattacttcgtacgttacggtaccacgacgaacgaaaaccaacgggaacacgccctacgtaagttgcctactaatttacgacggtcacgttaccgtacccggggtacggtcccgggtccctacggaaccgtacgttccgacggccggtacgacgggtaccggtcgtagaacgtaaccgtagtacgttttaccacttccgtacccaacctaagtaccaggaccacgtccgtacggaccgtaacggtccgtaagggaaacggttacggttacggtaccgggtaacgttttaaacggtttttaacctttacggtaccggtttaacctacgggtaaccgtttaagttaaaccgttttaaggtttaaccgttaacccggtttacccgttaacgtaaccggggtttttaacccgggggttttaccggggggaaaaccccgggggggtttaaacccaaacgggggttacccggttaaacgggtaaccggtttaaacccggtaaacccggggttttaaaaaaacccgtcccggggtttaagggtttaacccggtacccggtttaaccggaacccgtaaaccccgggttttaaccgtttcccccgggttttttaaccgggtaacccttttttacccggtaaaccccgtttttaccccccccgg

SEQ ID NO: 4544 - DNA, 601 bp, Homo sapiens
  misc_feature: GYAE6OF02FGP7M.39.31.C09.1.454.CMB.1.raw
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacataagattacttcgcttggtaccagcagaaaccngacagcctcctaagttgctcatttacnggcatctaccggagtccgggtcctgaccgattcgagcggcaggcggtctgagacagtactttcactctacaccgatcagcacgcctgcgaggctaggaacgtagtggtgtactagtttacttacgtgtcagcctaagttattagtaagttacgtacctacgtacgttacggttttacggggacccgggggtaacaaacggtcgttacgggaacgtacgtaaccgtaaaccggtaacgttcggtaccgggtccgttacggaccgtaaccctacgttaccggttacgtaccttttaccgtacctttaccccccgg

SEQ ID NO: 4545 - DNA, 573 bp, Homo sapiens
  misc_feature: GYAE6OF02HCKYB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaaacaataagaattacttcgcttggtaccagcagaaaccaggacagcctacctaagttgctctatttactgggcatccgtacccggggagtcccggggtccctgaccgattcgagcggcgagtcgggtctggagacagtactttcactctcaccactcagcacgcctgcaggctagaagtatggtggctagtttattacgtgtcagctaagttattagtagtagttacctagtacgttacgtttcgggaccggggtaactaggtcgtaggtagtacgtaacgaaacggtacgtaggtacggtcgtacgtaccgactacgttccgttacgttcttacgtacttccccg

SEQ ID NO: 4546 - DNA, 632 bp, Homo sapiens
  misc_feature: GYAE6OF02G37OU.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtggcgaggacgggccaccatcaactgcaagtccagccagagttgtttacacaggtccaacaataagaattactcgcttcggtaccagacaagaaaccgagacacgcctcctaagttgctctatttacncggctactcgacccgggtgtccgggtcctagacgacttcgacgtcggacgaggtcggtctgacgacgagtactttcacgtctacactatcaagcgacgtcctacgacggtctacggaagtagtggttacggcttaacgttttaactacgttgtacgtagtacttaagttacgtttaatacgttacgttccgttacgtacgtttaccggtttaccggggcccggggttaaactggtaccgtaggtaacgtaactacggaacggttaacggtcggttacggacgtctacgtaccgtacgttccttccggttctacccgttcgttaccccgttcccg

SEQ ID NO: 4547 - DNA, 709 bp, Homo sapiens
  misc_feature: GYAE6OF02IBLMZ.39.31.C09.1.454.CMB.1.raw
  modified_base (415)..(415): a, c, t, g, unknown or other
  misc_feature (415)..(415): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagaggccaccgatcaactgcaagtccagccagagtgttttacacgaggtaccaaacaataagaattacttcgacttaggtaccaggcaagaaccaggacagcctactaagttgctactatttcctggctacgtcgtacccgggtagtcccggggtcctgaccgtagtcaacggtccggcgaggcgggtactcggtagacagtactttccgactctaccaccatcacgcacgtcctggaccncggctaggaacgtagttcggtaggtactaagttttaacttacgttacggttacgtagtacgtaacgtttaagttaacttacggtttaacgttacccgttcgtaacggttttacccgggttttaccggggacccggggggttaaacctaaacgggtcccggttaaggggtaccttaacgggttaaaccgtaaaacccgggtaccgttacgggtacggggttccctaacggtaacccgttaacccgtacgtttacccggttacggttttccccttaccgtaccgtttacccccccg

SEQ ID NO: 4548 - DNA, 623 bp, Homo sapiens
  misc_feature: GYAE6OF02IP5XB.39.31.C09.1.454.CMB.1.raw
  modified_base (311)..(311): a, c, t, g, unknown or other
  misc_feature (311)..(311): n is a, c, g, or t
  modified_base (374)..(374): a, c, t, g, unknown or other
  misc_feature (374)..(374): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttgtttacacgaggtaccaaacaaataagtaattacttcgtcttaggtaccagacaacgaaaccaggaacagccctactaagttcgactactatttacgngggcctagtcccgacccggggtacggttcccggggtccctcggaccgtattccgacggccggngacggtcgggtctggacgactaggtactttcactctaccacctatccgagcacgccgtgacgaggctagaaggagtggtacggtacttagtttactacgttgtacagtcttaagtataatagtactccttagacgtttacggttcggggacccggggtaaccaaggtcggtaggacgtacgtaacgaacggtactacgggagtcctaacgacctacgtcttaccgtcgtttaccttccgtacttccccg

SEQ ID NO: 4549 - DNA, 617 bp, Homo sapiens
  misc_feature: GYAE6OF02GST52.39.31.C09.1.454.CMB.1.raw
  modified_base (308)..(308): a, c, t, g, unknown or other
  misc_feature (308)..(308): n is a, c, g, or t
  modified_base (376)..(376): a, c, t, g, unknown or other
  misc_feature (376)..(376): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttacacacggtaccaaacaaataaagtaatttacttcgcttacggtaccaggccaagaaaccaggacacgcctacctaagttgctactatttacgngggcagttccgtacccggggaggtcccggggtcctacggaccgtacttcgagccggcgaggcgggtcngagactagtactttacactctacacctatcacgcacgcctagaccgaggctaggaagtatgtcggtacgtagttttacttacgtgtacgagactagtaattagtagttcgtcctacgtagttcggtttcgggaccggggtactaaggcgtaggacgtacgtaacgaaacggtacgtaggtacggtaccgttacggaaccctaccgtacgttcgtttaccgttacttctacccgtttccccg

SEQ ID NO: 4550 - DNA, 726 bp, Homo sapiens
  misc_feature: GYAE6OF02I4TIX.39.31.C09.1.454.CMB.1.raw
  modified_base (647)..(647): a, c, t, g, unknown or other
  misc_feature (647)..(647): n is a, c, g, or t
  modified_base (697)..(697): a, c, t, g, unknown or other
  misc_feature (697)..(697): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggacgggccaccatcaactgcaagtccagccagagttcgtttacactaggtaccaacaataaagtaacttactcgtcgttacggtacctagacaacgaaaccgaacggacacggtaccctaccttaaggttacgtcctacttaactttacgttacgggctacgttaccgtacccgggacgggtcccggggtcccgtacgacccggtacttacgcgccggtacacgggtaccggtcgtaggacgaaccgaattacgtttacctaccgttcccttaccacccgtaactaccgagtaccgaacgtcccttaggaccggacggtcggttaaggaaaggtagttgggtcgtacgtttaacggttttactttacgttcgactaggaccttagttatttaaggttacgtttacgtccgttatacggggtttaccggtttacggggacccggggaaaccctagcggttaggaacgtntaacccggtaaagccgttgggtaccgcgtacgacccttactaaccggttnttccggtttaacctggttcccttaccccg

SEQ ID NO: 4551 - DNA, 591 bp, Homo sapiens
  misc_feature: GYAE6OF02H1G4Q.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaaacaaataagaattacttcgcttggtaccagcaagaaaaccaggacagcctactaagttcgctactatttactggcactccgtaccgggtacgtcccggggtcctgaccgtattcgacgcggcaggtcgggtctgagacagtactttcactctacaccatcagcagcctgacgaggctagaagatggtgtacgtagtttattacgtgtacgagactagttataagttagtacgttccgtactacgttacgtttacgggaccggggtaacctaagtcgtaggacgtactaccgtaaacgtaacgtacggtcggtcgtacgaccgtaaccgtacgttcgttaccgtttcttaccgtactttccccg

SEQ ID NO: 4552 - DNA, 740 bp, Homo sapiens
  misc_feature: GYAE6OF02IQEKK.39.31.C09.1.454.CMB.1.raw
  modified_base (167)..(167): a, c, t, g, unknown or other
  misc_feature (167)..(167): n is a, c, g, or t
  modified_base (318)..(318): a, c, t, g, unknown or other
  misc_feature (318)..(318): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacgggacatcgtgatcgacccagtcctaccagacctccctggctgtntctctgggcgagaggccaccatcaactgacaagtccagcctagagttgtttacacgtaggtaccaacaataaagtacttacgttcgtcgttacggtaccagcaacggaaaccaggacacgtcccttactaagttcgactctaactttacgnggtcaagtccgtaccggtacggtcccgggtcctacggaccgtattacgacggcggaacgcggtcggttctaggaacgtaccgaggttaactttcccgacctacttacccgaacctaacgttccgacgtaccggaacgtccgtacgcgtaaccggtagtaacggtatacggtagtcggtacgttaacggtttatacgttacgtcgaactagtaccttaaagtacgttaacgttaccgttaccgtaccgttaacggtttacccgggttttaacggggacccggggaaaccgtaaacggttcgggttaacggaacggtaaccgtaaccggttaaaaccgtcggttttacgggaccgttaccggttaacgtcccgaaaccgtttccgtcgttaccggtttaaccttaccgttaccggtttcccccg

SEQ ID NO: 4553 - DNA, 605 bp, Homo sapiens
  misc_feature: GYAE6OF02GHNAL.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattactcgcttggtaccagcagaaccaggacagcctcctaagttgctctatttacgnggcactccgtaccccgggtaggtcccggggtccctgaccgtacttcgagcggcacggcgggtctgagacgagtactttcacttctcaacctatcagcacgcctagcgtagctagaagtagtggtagtacgttagtttacttacgtgtacaggtactaagttatttaagtacgttacgttaccgtacgtaacgtttacggtttccggggaaccgggtaaccacggtcgttagggacgtagtaccgtaaacggtaacgtacggttacggcgttacgccgtaactacgtccgttagtacctttcaccgtttcccg

SEQ ID NO: 4554 - DNA, 583 bp, Homo sapiens
  misc_feature: GYAE6OF02GCCTX.39.31.C09.1.454.CMB.1.raw
  modified_base (299)..(299): a, c, t, g, unknown or other
  misc_feature (299)..(299): n is a, c, g, or t
  modified_base (336)..(336): a, c, t, g, unknown or other
  misc_feature (336)..(336): n is a, c, g, or t
  modified_base (379)..(379): a, c, t, g, unknown or other
  misc_feature (379)..(379): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagttgtttaacacacggtaccaaacaaataagaacttactcgcttggtaccagcagaaaccaggtacagcctctaagttgctcatttacgnggcatccgaccggaggtcccgggtcctgaccgtatcnggcgcaggcggtctgagacagtattcactcctacaccatcganccacgtctcgccacggtcgtagaagtatggtcggactttaggtttattacgttccgtagtacgtctaagtaatttagtacgttacgtacgttacgtacgttacggtttacggggaccggggtaacacggtcgtaggagtacgtaacgaaacggtagtacggtaggtcctagcctacgtactcttcgttcttacgtaccttcccg

SEQ ID NO: 4555 - DNA, 725 bp, Homo sapiens
  misc_feature: GYAE6OF02HKDLZ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagagttgttttacacacggtaccaaacaataagtaattacgttcgtcgttgtaccaagcaaacgaaccaggacagccctacgtaagttgctactatttacgtcgggcacgtccggtaacccgggtacggtcccgggtcccgtgaaccgtacttcgacggtcgcgacggtcggggtcgtaggagacagtacttcgactctacaccatcacgcacgcgtcgacgaggtcgtaagaagtacgttggtacggtcgtttaagttttacgttacgttagtcgtacgtacgttaaacgttagtttaacgttacggttaaccgttccttacggttaaccgtttaacggggttttaccgggggaacccgggggttaaaccgtaaacggtccgttaagggttaacgtaaccgtaaacccggtaaaaccgggtaacggttacgggttcgggtaccgttaaccgggaacccttacgttaccggttaccgtttaccggttttaccgtttacgttacccgttttaaccccgg

SEQ ID NO: 4556 - DNA, 600 bp, Homo sapiens
  misc_feature: GYAE6OF02GQ39Z.39.31.C09.1.454.CMB.1.raw
  modified_base (398)..(398): a, c, t, g, unknown or other
  misc_feature (398)..(398): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagttgtttacacgaggtccaaacaataagaattacttcgcttggtaccagcaagaaccaggacagcctactaagtgctctatttacgtggacatccgtacccgggagtccccgggtccctcgaaccgtagttcgacggccggtcgacggtccgggtctggacgacagtatttccacttctaccaccataccngacagccctgcgagcgtagagtagtggtggactagttttattacgtgtacgtacgctagttacttagtaacgtacgtacctagtacgttacggtttcggggaccgggtacctaaggcgtacgggagtacgtaacgaaccggtaacgtggtcgtaccgtacgaccgtaccgtcgttaccgttcgtacttacgtacttaccccg

SEQ ID NO: 4557 - DNA, 752 bp, Homo sapiens
  misc_feature: GYAE6OF02IES9P.39.31.C09.1.454.CMB.1.raw
  modified_base (385)..(385): a, c, t, g, unknown or other
  misc_feature (385)..(385): n is a, c, g, or t
  modified_base (658)..(658): a, c, t, g, unknown or other
  misc_feature (658)..(658): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctcccgtggctgtgtctcgtgggcgaggacgggccaccatcaactgacgaacgtccgacgccagtagttcgtttacacgtacggtaccaaataaataagtaacttactcgtcgttaggtaccaggaccaagaaaccaggtacacgcctactaagttcgctactattacgtggacacgttaccgtaccgggtcgtcccgggtcctcggacctagttcgacggcggtacgnggtaccgggtcgtacgaacgacgtagtacttttccgaccttaccttccgaacttacgtacaacgtaccgaacgtccgttacggaccgtagggtaccgtaagtaacggttacgttacggggttcggtacgtttaaacggttttaactaccgttacggtaccgtaccggtaagttaagtttacttaaaggtttacgttaccgttaaccgttagtaaccggtttaccgggttttacccggggccggggtaaacctacggtagggtacgacggttanaaccggtaaaaccggtaaggttccggtaacggtccgttacgaccgtaacccgttacggttcgttaccggttccttaccctagtttaacccccgg

SEQ ID NO: 4558 - DNA, 716 bp, Homo sapiens
  misc_feature: GYAE6OF02IF8JG.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagactccctggctgtgtctcgtgggcgaggacgggccaccatcaactgacaacgtccagccagtagttagttttacacgtacggtaccaaacaaataaagtaaacttacttcgacgttacggtaccagtacaacgaaaccaggacacgccttacgtaacgttcgactactaatttacgtcggtactacgtaccggtacccggggacggttacccggggtccctacggaccgtacttccgacggtccggacgtacgggcgggtctaggaacgtacgaggttactttcgaaccgttcctaccgaaccgtacttaccggacgtaccgtaacggtcccgtaggtccggaacggtaccgtaaggaaacgttaggttcgggtacgtacgtttaacgttttacttacgtcgtacgagtaccgttaagttaactagtacgttcgtaacgtacgtacggtttacgttaccggggaccggtaacgtacgtcgtaggacgtacgtaaccgaagtaacgtcggtacggtcttaccgacctaccgtaagttccgttaggtaccttcggtacctttcccg

SEQ ID NO: 4559 - DNA, 690 bp, Homo sapiens
  misc_feature: GYAE6OF02IHO7B.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgtagacccaggtcttcatttctctgttgctctggatctctggtgcctacggggacatcgtgatgacccagtctccagactccctggctgtgtctcgtgggcgagaggccaccatcaactgcaagtccagccagagtgtttacacaggtccaaacaataagaattactcgcttggtaccagcaagaaaccaggacagcctcctaagttgctctatttacgngggcagtccgtacccgggtagtcccgggtcaccgtgacccgtattccgaggcggcgaggccgggttctgacgacagtactttccgactccgtacaccactaccgacgcaacgccgtagccgtaaggccttaggaaacgtagttgggtacggtacgttaacgttttacgtttaaccgtggtaccgaagtccgttaaaggttaactttagtaacggttaccgttacccgtaacgtacggtttaaccggttttaccgggggaaccccggggtaactaacggtaccggtaggggtaaccgttacgaaaccgtaaaccgggtaacgttacggtaccggtaccgttaccggaccctaaccgttagttcccgtttacgttacccgttactccgtttacccccg

SEQ ID NO: 4560 - DNA, 575 bp, Homo sapiens
  misc_feature: GYAE6OF02GT3N6.39.31.C09.1.454.CMB.1.raw
  modified_base (343)..(343): a, c, t, g, unknown or other
  misc_feature (343)..(343): n is a, c, g, or t
  modified_base (420)..(420): a, c, t, g, unknown or other
  misc_feature (420)..(420): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctatgtctctgggcgagagggccaccatcaactgcaagtccagccagtagtgttttacacaggtccaaacaataagaattacttcgcttggtaccagcaagaaaccaggacagcctctaaagttgactcatttactgggacagtccgtaccgggagtccggggtcctgacccgattcagcggnaggcgggtctgaagacagtatttcactctacaccatcagactagctgcaggctgaagatgtagtctagtttactagngtcagtcaagtattactagttactcctacgagttacgtttcgggaccggggtaaccaaggtaccgttggaaggtactaacgtaaacgtaaccgtaggtcgggtactaggtacccaacgttacgttcctaacggttcctttacgaacgtttccccc

SEQ ID NO: 4561 - DNA, 654 bp, Homo sapiens
  misc_feature: GYAE6OF02FZXI8.39.31.C09.1.454.CMB.1.raw
  modified_base (315)..(315): a, c, t, g, unknown or other
  misc_feature (315)..(315): n is a, c, g, or t
  modified_base (434)..(434): a, c, t, g, unknown or other
  misc_feature (434)..(434): n is a, c, g, or t
  modified_base (461)..(461): a, c, t, g, unknown or other
  misc_feature (461)..(461): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacacggtaccaaacaataaagtaaattaccttcgaccttggtacccaggccaagaaaacccaggaaccagtccctacctaagttgcctctatttacngggcatccgtacccgggacgtcccggggtcctgaccgtattcgacgcggtacaggccgggtctaggacgacagtacttttcactctacacctatcgagcacgcctgcaggctaggaagntgtgtactagtttagttactgtacganacgtattacttagttacgtacgttactacgtacggttacgttttcggggacccggggtaactaaacggtcgttacggggaagtacgtaacccggtaaaaccggttacgttacggtacggggtacctaccggtacccgtaacccgttacgtttaccgtttacgtttaccgttacccttacccgttttccccccg

SEQ ID NO: 4562 - DNA, 538 bp, Homo sapiens
  misc_feature: GYAE6OF02GRE89.39.31.C09.1.454.CMB.1.raw
  modified_base (367)..(367): a, c, t, g, unknown or other
  misc_feature (367)..(367): n is a, c, g, or t
  modified_base (528)..(528): a, c, t, g, unknown or other
  misc_feature (528)..(528): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctagggcgagagggccacatcaactgcaagtccagccagagtgttttacacaggtccaacaataagaattacttcgcttggtaccagcagaaaccaggacagcctcctaagttgcttcatttactgggactatccgtacccgggtagtccgggtccctgaccgattcagcggcagtcggtctgagacagatttcactcncaccatcagcagtcctgcaggctagaagatggtcgctagtttagttactgtacagtctagtattatagtactactctagtacgtttcggccgggtacagtcgtggatacgacgaaccggaagttcggtaggcgttgacctaccgtagttacctgtcttacncgttaccccg

SEQ ID NO: 4563 - DNA, 614 bp, Homo sapiens
  misc_feature: GYAE6OF02FQPTS.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattaccttcgcttggtaccagcaagaaaccaggacagcctcctaagttgctcatttacngggtcatccgtacccggagtccggggtccctggaccgtattcaggcgcagcgggtctagacgacagtactttcacttcaccacattcacgtcacgtcctgacaggctagaagtattgtggtacgttagtttacgttacgttgtacgagtactagttactttaagttagttaacgtccgttacgtacgtttacggtttttcggggtacgggggaacctaacggtacgttacggacgtagtaaccgtaaaccgtaacgtaggttcgggacttcgtacccgtaccggttacttcggttcctttcgtacgttcccgttaccccg

SEQ ID NO: 4564 - DNA, 756 bp, Homo sapiens
  misc_feature: GYAE6OF02HTWS9.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctggctgtgtctcgtgggcgagacgggccaccatcaactgacaagtccagccagtagttacgtttacacaggtaccaaacaaataagtaacttacttcgtcgttaggacctagcaaacgaaaccaggtaaccacgtcccttacccttaagttcgaccttacgtacgttttacgtcgggacctagtccggtaaccccggggtacggttaccccggggtccctacggaccgtaattccgacggcggacgacggtacgggtcctaggacgtactacgtacttttccgacttacctacgaaccctacgtactacgacctacgcccgtacggaccgacggtccgttaaaggaacgtagttacggtcggtaacgtttacgttttaacgttacgttacggttacacggttaaccgttaggttaaacctttaaggtttaacggtttacgttacccttaaggtacggtttaccgggttttaccggggaaccggggttaaccagggttacgtacgggaacttacgtaacccggaaaggtaccgttacggtcggtaccgtctaccgtaaccgttcgtaccgtttacgttaccttacgtccttaccccgg

SEQ ID NO: 4565 - DNA, 597 bp, Homo sapiens
  misc_feature: GYAE6OF02JJVJ1.39.31.C09.1.454.CMB.1.raw
  modified_base (365)..(365): a, c, t, g, unknown or other
  misc_feature (365)..(365): n is a, c, g, or t
  modified_base (411)..(411): a, c, t, g, unknown or other
  misc_feature (411)..(411): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaacaataagaattactcgcttggtaccagcaagaaaccaggacagcctcctaagttgctctatttaccgtgggctatccgtacccgggacggtcccgggtccctgaccgattcgagcggtcacggcggtctagagacgngtactttcactctacaccatcagccagcctgacgaggctagaagtntggtgactagtttattactgctagctaagttattagtagttacgtcctacgtacgttacgttttccggggacccggggtaaccgaagttccgtagggtaagtaccgtaacgaaaccgtaacggttacggtggtaccgtccgaccgtacctacgttccgttacgtacctttacgaccgtttccccgg

SEQ ID NO: 4566 - DNA, 517 bp, Homo sapiens
  misc_feature: GYAE6OF02I82GA.39.31.C09.1.454.CMB.1.raw
  modified_base (389)..(389): a, c, t, g, unknown or other
  misc_feature (389)..(389): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
  modified_base (497)..(497): a, c, t, g, unknown or other
  misc_feature (497)..(497): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccggggagtccggggtccctgaccgattcagcggcagcgggtctgagacagatttcactctcacatcagcagcctgcaggctgaagntgtggctagtttatacttgtcagctagtattatagtagtcctcagttacgtttgggccgggtacaaggctaggganagtacgaaacgtacttggnggtctgacacctnttcctggtcttacacttccg

SEQ ID NO: 4567 - DNA, 765 bp, Homo sapiens
  misc_feature: GYAE6OF02I1U3C.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccacatcaactgcaagtccagccagagttcgttttaacacgtaggtaccaaacaaataaagtaacttaccgttcgtcttacggtaaccagacgaacgaaaaccaggaaccacgccccttacctaaggttcgacttactatttacgtgggtctacgttccggtaacccggggtacggtccccggggtcccctaggacccgtacgtttccgacggtccggtacgacgggtcgggtcgtaggaacgtaccgtaagttacttttaccgacgttcctaccgacccgtactaccgaacgtaccgtaacgtccgttacggacgtaacggtccgtaaggaaagttaggtacggttaggtaccttagttttaacttagttacgtacgagtaccgtaagttactttaacgtaaggttaccgttacccgttcgtaacggtttacccggttttacgggggacccggggtaaacgtaacggtaacggtacgtaacggaacgtttaaccgaaaccggttacgttacggtacgggtacgtaccggtacctaacccgttacgttaccgtttacgtcccgtttaccgtacctttaccccg

SEQ ID NO: 4568 - DNA, 587 bp, Homo sapiens
  misc_feature: GYAE6OF02HHRSN.39.31.C09.1.454.CMB.1.raw
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtaccaacaataagaattacttcgcttggaccagcaagaaaccaggacagcctacctaagttgctactatttacgngggctatccgtacccggggagtcccggggtccctggaccgtattcgagcggcagcggtctgagacagtactttcactctcaaccactcgagcacgcctgcgaggctagaagagtgtacggtacttagtttacttagtgtcagcgtaagttattacgttagtacgttacctatacggttacgtttacggggacccgggtaacacggtcgtaggacgtacgtaccgaaacggtacgtacggtacgtacgttacggacctaccgtacttcgttacttacttacgtccttacccg

SEQ ID NO: 4569 - DNA, 638 bp, Homo sapiens
  misc_feature: GYAE6OF02IU118.39.31.C09.1.454.CMB.1.raw
  modified_base (231)..(231): a, c, t, g, unknown or other
  misc_feature (231)..(231): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (366)..(366): a, c, t, g, unknown or other
  misc_feature (366)..(366): n is a, c, g, or t
  modified_base (412)..(412): a, c, t, g, unknown or other
  misc_feature (412)..(412): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctgctgtgtctcgtgggcgagacgggccacctatcaactgacagtccagccagagttgtttacacaggtccaanaataagtattactgcttaggtaccagcaagaaccaggaccagccctactaagttcgntctaattcngggctactacgtcccgggacgtcccggggtcctcggactcgttcgcggtcgccgagggtccggttaccnggacgtaacgtgtaacgtttccacgttctccaaccttatccgacgngtaccgctcgacgcggtactaggaaagtgtacggtgtaccttaagttttacgttacttcggacttcgaagttagttactagtttacggttactccgtacgtagttacccggttttaggggacccgggttaccgtaagtccggtagggtactacgttaaccgaaacggtaccgttggtaagtccttaagccctaacggtctccgtttaggccttactaccttccccg

SEQ ID NO: 4570 - DNA, 665 bp, Homo sapiens
  misc_feature: GYAE6OF02G0H9Q.39.31.C09.1.454.CMB.1.raw
  modified_base (400)..(400): a, c, t, g, unknown or other
  misc_feature (400)..(400): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagacggccaccatcaactgcaagtccagccagagttgtttacacaggtaccaaacaataagaattaccgttgcttggtaaccagacaagaaaccgaggacagcctacctaagttgctactatttacgtggcatccgtaacccggggagtcccggggtccctggaccgtattccgaggcggtacaggtcggtctagagacgtagtactttacacgtctaccgaacnctacagctagcccgtgaccgaggactaggaagtagttcgtaggtaccgttagttttaacttacgtcgttacgtacgtacgtaagttaatttacgttaacgttacgttacccttacgtaacggtttaccgttttaccgggggacccgggtaaaccgtaacggtacgtaaggtaacgtacgtaaccgtaaacggtaaccgttagggtccggtacgtccgtaccgaaccgtaacgttcccttaggtacctttaccgtaccttccccgg

SEQ ID NO: 4571 - DNA, 652 bp, Homo sapiens
  misc_feature: GYAE6OF02FMFEP.39.31.C09.1.454.CMB.1.raw
  modified_base (169)..(169): a, c, t, g, unknown or other
  misc_feature (169)..(169): n is a, c, g, or t
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctntgggcgagagggccaccatcaactgcaagtccagccagagttgttttacacgaggtccaaacaataagaattactcgcttggtaccagcaagaaaccaggacagcctcctaagttgcttcatttacngggacagtccgtaacccgggaggttcccggggtaccctcggaccgtagttccgagggtccgcgaggccgggtctggacgacagtactttcgacttcctacacctatcagctacgccgtgcgaggcctagtaacgtagttcggtcggtacgttagttttaacgttcgttagttacgtagacgttagttaattagttaacgttcgttaccttacgtacggttaacggtttccgggaccgggggtaacctaacggtaccgttagggaacgtacgtaccgaaacggtaacgttggtaggtacccgtagacccgtaacttacgtccggtttaccgtaccgttttacctaccgtttaccccg

SEQ ID NO: 4572 - DNA, 750 bp, Homo sapiens
  misc_feature: GYAE6OF02J0VG7.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggacgggccaccatccaactgacaacgtccacgaccagtagttgtttaaccgacgtacggtaccaaactaaagtaaagtaactttacttcgtcgttacggtaccagtacaacgaaaaccgaggaccacgtccttaccgtaaggttcgtaccgtacttacgttacggcggactacgtaccgtaccgggtaccggtcccgggtcctagtacccgtagtcgacggcgcgtaggtccggtatcggaacgacgtagttacgtttaccactacctaccgactcgtacgagtacgcgtccgtaggaccgacggtagttacggaaagttacgttcggtacgggtaaccttttaagttttaccgtcgtacggttaacgacgttaacgttaacgttattaaacgtttaacggttccgtaccgtttacgtaacggtttacccgggttacgggggacccgtaaacgtaggttcggtacgtaacgtacgttaaccggaaagggtttccggtaggtaacctcccgggtaacttaccgttaacccgttggttacgttacccggttcctttaacgtcccttaccccgg

SEQ ID NO: 4573 - DNA, 576 bp, Homo sapiens
  misc_feature: GYAE6OF02HLAT9.39.31.C09.1.454.CMB.1.raw
  modified_base (566)..(566): a, c, t, g, unknown or other
  misc_feature (566)..(566): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctaagtgtctctgggcgagagggccaccatcaactgcaagtccagccagagtgttttacacaggtaccaacaataagaattacttcgcttggtaccagcagaaaccaggacagcctctaagttgctcatttactgggctatctacccgggagtcccggggtccctgaccgtattcagccggcagtcgggtctgagtacagtactttacactctacacctatcacgcacgtcctgcaggtctagaagacgtggtgacttagtttattactgtacagtactagttattagtagttacgtcctacgtagttaccggttttcggggacccggggtaactaggtccgtaggacgtactaacgaaacgtcgtaggtcggtacgtacgacctacctacttcgtcgttaccttntacttccccg

SEQ ID NO: 4574 - DNA, 719 bp, Homo sapiens
  misc_feature: GYAE6OF02H3NWF.39.31.C09.1.454.CMB.1.raw
  modified_base (319)..(319): a, c, t, g, unknown or other
  misc_feature (319)..(319): n is a, c, g, or t
tcagtcgcactagtcacgaccggtgctcgatttagacgtctcatcaaggaaggaagggcagcaagatggtgttgcagacccaggtcttcatttctctgttgctctggatctctggtgccgtacggggacatcgtgatcgacccagtcctccacgacctcccgtggctgtcgtctcgtgggcgaggacgggcccaccatccaactgacaacgtccagccgagagttacgtttacgacgacggtaccaaacaaataaagtaacttacttccgtcgttacggtaccagaccaacgaaaccgaggacacgtccgtactaagtnctactattaccgtgactacgtaccggtaacccggtaggttccccggtcctacggaccgtacgttcgacggccggacgacggtccggtactggaaacgtcgtacgttactttacacgtacctaccaacgtactaccgaacgtaccgaccgtccgtacgcccggtaaggtaccgtaacggtaagtacggttgtacgggtaacctttagttttacgtaccttaaggtcgacgtacgtaagttaattacgttacgtccgttacgtacgtacgggttaccggttacggggacccggacgacgtcgtaacggtagtacgtaaccggaaccgtacgttacggtcggtaaccgtccgaacccgttaccgcgtttacgttcccgtactttacccgtacccgttaccccg

SEQ ID NO: 4575 - DNA, 659 bp, Homo sapiens
  misc_feature: GYAE6OF02IT6ER.39.31.C09.1.454.CMB.1.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagacagaaccaggacagcctctaagttgctacatttacncggacagtccgtacccggagtccggggtccctgaccgtattcgacgcggtcaggtccgggtctgaacgacgagtaacttttccaacgtctccaacgtatcgacgcaacggtcctacggacgacggacgtacggaaagtagttcggtacggtacgttaagttttacttaacgttcgtacgtagaccgttaaggttaaactttagtaacggttacgttaccctacgttacgttaccggttttaccggggaccgggggtaaacccgtaaggttaccgttaggaacgtaacgttaccgtaaacggtaacgttagggtacgtacgttaccgacctaccgtaagttccgttacgtacctttacgtactttccccg

SEQ ID NO: 4576 - DNA, 784 bp, Homo sapiens
  misc_feature: GYAE6OF02HFBKZ.39.31.C09.1.454.CMB.1.raw
  modified_base (297)..(297): a, c, t, g, unknown or other
  misc_feature (297)..(297): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagttgtttaccactacggtaccaaacaataaagaattaccgttcgtcttaggtaccagacaagaaaccaggacacgcctactaagtcnctactatttacgcggtacacgtcgacccggggagttcccggggtcctaggaccgtattccgacggccggcgacggtccggtacgtaggacgactagtactttaccgactcctacaaccctataccgaacgtccgtacgtccgttacgacgacggtaccgttaaaggtaacgttacggttcgggtaacggttactttacggtttttaacttaccgtcggttaaccgaacggtaccttaaggtttaacgttaacgtttaacggttaacgttccccgttaacggttacgggttttaaccgggttttcgggggaaaccccggggttaaaccggtaaacggtttccggggaacgggtttaacggtaaccgtttaaaccggtaaaacccgggttaccggtttagggtaacccgggtaacgtaccgggtaaccccaaccgtttaccgttaccgtttaccgttacccgttttacccgacggttttacccccccgg

SEQ ID NO: 4577 - DNA, 811 bp, Homo sapiens
  misc_feature: GYAE6OF02FME3L.39.31.C09.1.454.CMB.1.raw
tcagtcgcactagtcacgaccggtgctcgatttagacgtctcatcaaggaaggaaggggcagcaagatggtgttgcagaccaggtcttcatttctctgttgctctggatctctggtgccgtacggggacatcgtgatcgacccagtcctccagacctccctggctgtgtctcgtgggcgaggacgggccaccatccaactgacaacgtaccacgaccaggtagttacgttttacacgtacggtaccaaactaaactaaagtaactttaccgttcgtacgttacggtaccacgaccgaacgaaaccgacggaccaccgtaccctaccgtaacggttcgtccttactaacgttttaccggtcggggtactaacgttacccggtaacccgggggtaccgggtaccccgggggttaccccgtacggaaccggtacgttaccggacgggtaccgggcgtacgggtccggggttctacggaacggtacgtaacgttacgtttacctaccgtcctacctaacccgtactaccgacgaccgacgtccgtcgtacgtacggtacgtacgacggtagtacggtacggtacgttacgttacgttacgttacgtacgtacgtacgtagttattacgtacgttacgtacgtacgtacgttacggtttaccgggtaccgggtaaccgtacggtacgtacggtacgtacgtaacgtaacggtaacggtacggtacggtcggtactaccgggggggggggggggggggggggggggggggtaccttacggttaccgttaccgttaccgttaccgttaccgttacccg

SEQ ID NO: 4578 - DNA, 691 bp, Homo sapiens
  misc_feature: GYAE6OF02G4RFX.39.31.C09.1.454.CMB.1.raw
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagaggccacatcaactgcaacgtccagccagagttgtttacacgacggtaccaaacaataagaattacctcgcttggaccagcagaaaccaggacagcctactaagtcgactcatttacgnggcacgtccgtacccgggnggtcccgggtcctgaccgtatcgaggcggacgacggtcggtactggaacgactagtatttaccgactccttaccaaccgtataccgacgacgtaccgtccctaggaccacgggtacttaacggaaaggtagttcgggtacgggtacttaacggtttttacgttaccgttgttaaccgagtaccgttaaagtttacgtttaaggttagttaaccgttacccgtacgttagtttacccggggttttacgggggacccggggtaaaccgtaacggtaccgggtaagacggtaactaaccgtaaaacgtcggttaacgggtcgtacgtacgtaccgtaacctacgttccgtttaccgtactttacgtcctttaccccgg

SEQ ID NO: 4579 - DNA, 729 bp, Homo sapiens
  misc_feature: GYAE6OF02J1YF6.39.31.C09.1.454.CMB.1.raw
  modified_base (335)..(335): a, c, t, g, unknown or other
  misc_feature (335)..(335): n is a, c, g, or t
  modified_base (640)..(640): a, c, t, g, unknown or other
  misc_feature (640)..(640): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtgatcgacccagtcctccagacctccctggctggtgtctcgtcgggcgagacgggccaccataccaactgaccaacgtccagccagtgttacgtttaccacgtacggtaccaacaataagtaacttacttcgtcttacggtaccagacaacgaaaccgaggaccacggcccttaccgtaagttcgactactagtttacgnggacctacgtaccggtacccggggtacggtcccgggtcctacggtaccgtacgttccggacggccgggacgtaacgggtccgggtcgtaggaacgtacgtaggttactttaccgaccttccgtaccaaccgtactacgacgaccgtaccgcgtacgacgtacggtactaggaagtgtacgtcggtacttagttacgttcgtcgtacctaggtacttaagttaacgttcgttaacgtacgttccacggttaccgttaccgggttccggggaaccggggtacctacgggtacggttaagaccggtanaaaccggttaacggtaacgttacggtacgtccgtacctaccgttacgtacccggttacttacgtttacccgtaccttacccggttaccc

SEQ ID NO: 4580 - DNA, 694 bp, Homo sapiens
  misc_feature: GYAE6OF02JZD43.39.31.C09.1.454.CMB.1.raw
  modified_base (335)..(335): a, c, t, g, unknown or other
  misc_feature (335)..(335): n is a, c, g, or t
  modified_base (659)..(659): a, c, t, g, unknown or other
  misc_feature (659)..(659): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacgggccaccgatccaaactggacctaagtccaacgccgagaagttgttttaacaccgacggtaccaaactaaattaaagaaactttaccgttcgctttacggtaccagtcaacgaaaccgtaggacacgcctacgtaagtcgctactactttacgnggtcacgtccgtaacccggggtcgtccccgggtctacggtaccgtagtcgacgtccggacgaggtccggtctaggacgtacgagtacctttcactctacaccatacgagcacgcgtcgaccgagtcaggaacgtagtcgtacggtactttaagttacgtacgttagacgtagttacctaagttaatttcggttaacggttaccgccgtttaacgtaacggtttaccgggtttaccgggggaccggtaaactcggttacgacgggttaacgacttaacccgtaaaagggtccggtttaagcggtaactcccggtactaaccgttntacccgtttacgtaaccttcccgtatttcccccgg

SEQ ID NO: 4581 - DNA, 809 bp, Homo sapiens
  misc_feature: GYAE6OF02GWDLG.39.31.C09.1.454.CMB.1.raw
  modified_base (252)..(252): a, c, t, g, unknown or other
  misc_feature (252)..(252): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgccgtacggggacatcgtgatcgacccagtctccagacctccctggctgtgtctcgtgggcgaggaggccaaccatcgaactgacaacgtccaacgccaaggtagttcgttttaacacgtaacggtacccaaanaaataaagtaacttacgttacgacgtttacggtaaccagacgaagaaaccgaagacgaacgcccttaacgttaacgtcgtacctacttaagtttccggtacggactacgttacccgtacccggggtaaccggttccccggggttaccccgtaggtaaccccgtatttacccgaacgggtcggaccgtaccgggccggggttaccgtaggaacgaaaccggtaagttacgtttaccaaccttccgttaaccgaacccgtaattaccgaaccggaccacggacccgttcgcgtaacgggaccttacggaaacgtaggtcgggtacgggtacttaacgggtttaacctttacggttccgagttaaccggacgttaaagtttactttaaaggttaaggtttaccgtacccgttaccgtaaaggggtttacccggttagggggtaaccccgggggtaaactaacggtacgggttagtaacgacttaaaggaaaacccgtaaggttcggtaacggccgtagccgtaacacgttccgttgtacccgtttacctacccgtacccg

SEQ ID NO: 4582 - DNA, 704 bp, Homo sapiens
  misc_feature: GYAE6OF02GD74B.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctcgtgggcgaggacgggccaccatcaactgacaacgtccagccagtagttagtttacacgtacggtaccaaacaaagtaagtaacttaccgttcgtcgttacggtaccagaccaacgaaaccgacggacacgtaccttaccgttaagttcgccttactaacgtttacggtcgggactacgttacccggtacccggggtaccggtcccggggtaccctacggaccgtacttccgacggccggcgacgggtcgggtacgtaggacgacgacgttactttccacgttaccctaccaacctactaccgacgccgacgtccgtggaccgaggtacgtaaggaagtgtagggtcggtactttaaggtttacttacgtcgtacgagtaccgttagttatttagtacgttaccgtaccttacgtacgggtttccggttaccggggaccgggtaactacggtcgtaagggacttacgaaccgtaacgtcggtaggtacggtactacggacctacgtcgttcgttccgtaccttacgacttccccg

SEQ ID NO: 4583 - DNA, 764 bp, Homo sapiens
  misc_feature: GYAE6OF02HOUQY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctgctgtgtctcgtgggcgagacgggccacatcaactgacaagtccagccagagttgtttacacaggtaccaaacaaataagtaattacttcgtcttaggtaccagacaacgaaaccgaggacacgacctaccgttaacgttgctactatttacgtcgggactacgtccgtaccgggtacggtcccggggtccgtacggaccgtacgtacgacggccggcgacggcggtcgtgagacgagtactttactacgtactacactactacacgtacacgtcctagcgacggtcgtagaagtacgttaggtacggttacgttacgttttaactttacggtcgtacgacgtacgtaacgtttaatttaacgttaaggttaccgttaccgtttaaccgtaacggttttaccgggtttttacgggggaaccccggggggttaaaccgtaaacggtaccgggtaacgggtaacggttaaccgttaaaccggtaaaacccggttaaacggttaccgggtacgggttcccgttaacggtaccccgttaaaccgttacccggttacggtttttaacccggtttaaccgtttttaacccgttccccgtttaaccccccgg

SEQ ID NO: 4584 - DNA, 628 bp, Homo sapiens
  misc_feature: GYAE6OF02HZ1VM.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagttgttttacacaggtaccaacaataagaattacttcgcttgtaccagcaagaaaccaggacacgtcctacctaagttcgacttctattacgtgggactacgttaccgtacccggggtgtcccggggtccctggaccgtattcaggcgcgaggtcgggtctgagacacgtatttcgactcctcaaccatccgagcctaacgcctcgccgaggccgtagaagtgttggtacggacttagtttacttacgtcgtactagtactagttaacttagtacgttacgtacctcgtaacgttaccggttttcgggaacccggggtaaccgtacgtacgtaggagtacgtaacgaaaccgtacggtacgttcgggtacgtacgaccgtaccgtactaccgttacgttaccgttaccgtacctttccccg

SEQ ID NO: 4585 - DNA, 718 bp, Homo sapiens
  misc_feature: GYAE6OF02IGHXM.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgccgtacggggacatcgtgatgacccagtctccagacctccctggctgtgtctcgtgggcgaggacgggccaccatccaactgacaagtccagccagtagttgttttaccacgacggtaccaaactaataaacgtaactttacttcgtacgttaggtaccagacaacgaaaaccgagggaaccacgacccttaccgttaagttacgccttacttacttttaacgtcgggacctaacgttcccggaccccggggtacggttaccccgggggtccctcggaaccgtattaccgacggtccggacgtacgggccgggtcgtaggagacctaaggtactttccaacgttcctaccgaacctacgtccgacgtaccgacgtacccgtagccgacggtctaagggaaacgagttggtacggtactttaggtttaaccttcgtaggttaccagtacgttaagttacttagtacgtaccgtcttacgtagtttaccggttcggggaccgtacgaagtcggtagacgtataaccggaagttaccgtgggtacgtacccgtagacccgtttacgacgtttccgtacgtttaccgtacgtacctttcccccgg

SEQ ID NO: 4586 - DNA, 768 bp, Homo sapiens
  misc_feature: GYAE6OF02IUZ7R.39.31.C09.1.454.CMB.1.raw
  modified_base (305)..(305): a, c, t, g, unknown or other
  misc_feature (305)..(305): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctcgtgggcgaggacgggccaccgatacaactgacagtccagccagacgttagtttacacgtacggtaccaacaataagtaacttacttcgtacttggtaccagactaacgaaaccaggaccacgtacctacgtagttcnctactatttacgcggactacgtccgtacccggggacgtcccgggtcctacgaccgtatcgacgcggcgacggtccggtctacggaacgtacgtacggttactttacacgttccgtactaaccctacgttacacggtaccaccgtccgtaccggacgtacgggtcgtaagggtaagtcgtagggttacggtaacgtttagttttacgtaacgttcggtaacgtacgttaccgttaagttaacgtttaacggtacgttaccgtttacccgtaacgggtttaaccggttttccggggttttaaccgggggacccggggttaaaccgtaaggtacccgggttaacggtaaacggttaccgttaaacccggaaaccgggttaacgtttccggggaacggtcccgttaacggtacccctaacgttacgtttcccggttaaccgtttccttaccgttaccgttacccccg

SEQ ID NO: 4587 - DNA, 707 bp, Homo sapiens
  misc_feature: GYAE6OF02HXR7U.39.31.C09.1.454.CMB.1.raw
  modified_base (695)..(695): a, c, t, g, unknown or other
  misc_feature (695)..(695): n is a, c, g, or t
tcagtcgcactagtcacgaccggtgctcgatttagacgtctcatcaaggaaggaagggcagcaagatggtgttgcagacccaggtcttcatttctcttgtgctctggatctctggtcgccgtacggggacagtcgtgatcgacccagtcctccagacctccctggcttgtcgtctctgggcgaggacgggccaaccataccaagtcgacaacgtccagccagagttgtttacacgtaggacctaaagaataaacgtaatttacctccggtatttacggtaacctaggacgaaacgaaaaccaaggaccaacgccccttactaaggttcgacctataactttaccgtgggactagtaccgtaacccgggacggttccggacccgtagtacccgattccgtacggaccggtcgacggtccgggtactacggaacgtacgaacgttactttacccgatcccgtaccaatacgtcaacgtcgacgtccgtagccgtagtaccgagtaacgacgtggtacggtacgttacgttacgttacgttacgtacgagtaccgtaattataattacgttacttaccgtagtacgttacggtttacgggaaccgggtaaccgtagtaaccggtagtaacgggactaccggtaaacgtaccgtaggtacgacgtaccgaactccgtaacgtcgttacgttccgttacnccgtttaccccg

SEQ ID NO: 4588 - DNA, 530 bp, Homo sapiens
  misc_feature: GYAE6OF02GJSRA.39.31.C09.1.454.CMB.1.raw
  modified_base (290)..(290): a, c, t, g, unknown or other
  misc_feature (290)..(290): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctctaagttgctcatttacnggcatcgtacccgggaggtccgggtccctgaccgtattcaggcggcaggcgggtctgagacagtactttcactctcaccntcancagctgcaggctgaagngtgtgtactagtttattactgtcagtcagttattagtcgtagtcctacgtagttacgtttcggggaccgggacgagtcgtaggagtactacgaacgtaagtacgtggctgacctactactcttcgtcttactcttcccg

SEQ ID NO: 4589 - DNA, 703 bp, Homo sapiens
  misc_feature: GYAE6OF02JGJ98.39.31.C09.1.454.CMB.1.raw
  modified_base (216)..(216): a, c, t, g, unknown or other
  misc_feature (216)..(216): n is a, c, g, or t
  modified_base (274)..(274): a, c, t, g, unknown or other
  misc_feature (274)..(274): n is a, c, g, or t
  modified_base (352)..(352): a, c, t, g, unknown or other
  misc_feature (352)..(352): n is a, c, g, or t
  modified_base (400)..(400): a, c, t, g, unknown or other
  misc_feature (400)..(400): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtcctccagacctccctggctgtgtctctgggcgagacggcccaccatcaactgacaacgtccagccagagtntttacacaggtaccaacaataagaattacttcgcttgtaccagacaacgaacagaacncacctaccgtaagttcgctcatttacgtcggctacgtccgtacccgggacggtccgggtccctcggacctagttacgngaccggtcgaggcggtctagacgtcgagtactttcactcctacactancacgcacgcctagtacgacggtccgttaaggaaaggtcgttacggacgtacgttaagttttaccttagttcgtaccgtaagtaccgttaagtttaattagtaacggttacctaccgtttaacgaacggtttttacccggtttccggggggaacccggggtaaaccctaagggttacccgggttaacggacggttaacccgttaaacggtaaaccggtcggtttacggacgggtaccgttaccgaaccgttaaacccttcgggtttaccctgggtttaaccccttcgttaacccgttcccccgg

SEQ ID NO: 4590 - DNA, 743 bp, Homo sapiens
  misc_feature: GYAE6OF02G3VB5.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagacgggccacatacaactgacaagtccagccagtagttgttttacaacacggtaccaaactaaataaagtaactttacttccgtacgttcggtaacctaagaccaaagaaaacccgaaggaccacgacctacctagttgcctactagtttaccgtgggacctagttacccgtacccggggtacggttccccgggggttcccctacggaccggtacgttcacgggccggacgacgggtcggtacgtaggaagacgtacgtatttaccaccgttcctaccgtaccctaacgtcctaacggacctacggtcctacggaccgtacgggtaccgttaaggaacggtagttacgggtggtaacgtttacgtttttaactaccgttaggtactacggtacgttaagtttaattaagttacgttacgtaccgttacgttaacggttaccggttttacgggggacccggggttaacaaggttcggtagtaaccgtagttaaccgtaacggtaacggtcggtacggtaccgtacgtccgtaacttcgttagtaccggttacttcctaccgttccccg

SEQ ID NO: 4591 - DNA, 826 bp, Homo sapiens
  misc_feature: GYAE6OF02HR44H.39.31.C09.1.454.CMB.1.raw
tcagtcgcactagtcacgaccggtgctcgatttagacgtctcatcaaggaaggaaggggcagcaagatggtgttgtagacccaggtcttcatttctctgttgctctggatctctggtgcctacggggacatcgtgatgacccagtctccagactccctggctgtgtctcgtgggacgaggagggccaccatacaactcgacaacgtccacgccagtagttgttttacacgtacggtaccaaactaaataaagtaactttacttcgtcgttaggtaccagacaacggaaaccgaggacacgtacctactaagttcgctactacttacgtcgggactacgttaccggtacccggggtacggttcccgggtacccgtggaacccgtagttaccgacggcgggaccgacgggtccggggttactacggtaacgtacgtaacggttactttaccgaccttcccgtaccaaccgtaactaccgaacggtaccgtacgcccgttacggacggtaacgggtccttaagggaaacgtcggttacgggttacggttaacgtttaacgttttacgttaaccgttacgttaacgtacgttaacgttaagtttaagttacggttaacggtttaccgttacccgttacgggttaccgggttttaaccgggttttacccggggggaacccggggttaacgttaacgggtacggtaacgggtaacggttaactaaacccggttaaaccgttacggttcgggttaaccggtccgtaaccgtaaccgtacgttacgtttccggttacgtttacccgtttaccttacccgttaccccttacccgg

SEQ ID NO: 4592 - DNA, 631 bp, Homo sapiens
  misc_feature: GYAE6OF02HZ71Y.39.31.C09.1.454.CMB.1.raw
  modified_base (255)..(255): a, c, t, g, unknown or other
  misc_feature (255)..(255): n is a, c, g, or t
  modified_base (314)..(314): a, c, t, g, unknown or other
  misc_feature (314)..(314): n is a, c, g, or t
  modified_base (425)..(425): a, c, t, g, unknown or other
  misc_feature (425)..(425): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaacgtccagccagagttacgttttacacaggtaccaaacaaataagaattactcgtnttggaccagcaacgaaaccgaggacacgacctacctaagttcgacttactaatttacgngggactacgtaccgtacccgggacggtcccgggtccctacggaccgtattcgaggcggcagggtcgggtactggacgacagtactttcactctacacatcagcacgtccgngcgacggctaggaacgtagtggtacggtacgttagttttacttacgttcgtacacgtactagttattagttagttacgttaccgttacgtacgttacggtttcggggaccgggtaaccgagtacgtaggactacgtaacgaaacggtacgtacggtcggtacgtacgacctacgtacgttaccgttgtaccttactaccttacccg

SEQ ID NO: 4593 - DNA, 725 bp, Homo sapiens
  misc_feature: GYAE6OF02GI5UM.39.31.C09.1.454.CMB.1.raw
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccacatcaactgcaagtccagccagagttgtttacactaggtccaaacaataagaattactcgcttggtaccagcagaaccaggacagcctctaagttgctanatttacngggcatccgtacccggggaggtcccggggtccctaggacccgtactttcgacggtcgggacaggccgggttactcgaacgtacgagtactttcgaccttccgtcaacccgtataccgaacgccgaacgtcccgtaggcgaacgggtactaggtaaacgagttcggtcggtacttaaggttttacgtttacgttacgttacgtaacggactaagttaactttaagttaacggtaagttccctaccggtacggtttaccgtttttaaccggggggaccccggggttaaaccgtacggtaaccgttagggaacgtaacgttaaccgggtaaaaccgtaacggttaacgggtaccgggttaccgtaaccgggtacccgttaacccttaacggttcccggtttaacggttccccttaacgttccccgtttacccccgg

SEQ ID NO: 4594 - DNA, 821 bp, Homo sapiens
  misc_feature: GYAE6OF02G41HL.39.31.C09.1.454.CMB.1.raw
  modified_base (328)..(328): a, c, t, g, unknown or other
  misc_feature (328)..(328): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagacggccaccatcaactgacaacgtccagccagagttgtttacactacggtaccaaacaataagaacttacttcgctttaggtaaccagacaagaaaacccagggaaccacggtccccttaccgtaaagttgacctactaacgttttaccgnggggacctagttcccggtaacccgggggtacggttccccggggtccctaggacccgtattaccgaacggccggacgtacgggccggttcgtaggaaccgacgtaacggttacttttccaaccgttccttaaccgaacctacttaccgaacggtccgtacgtcccgttaggccggtaacggtccgttaaaggtaaggtaacggttggggtaccggttaacgttttaaacgtttttaaccgttacgtacggttaacccgtaacggtacctttaaaaggttttaacttaacggtttaaccgggttaaccgttaccccgtttaacggttaaacggggtttttacccgggtttcgggggaaacccccgggggttaaactaacggggttaccgtaggggtaaccgtaccgttaaaccggaaaaccgttcggttacggtacggtacctccggaacctacggtacgttccgttaccgttacttacccgtaccgtttccccg

SEQ ID NO: 4595 - DNA, 741 bp, Homo sapiens
  misc_feature: GYAE6OF02H7WJ6.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtcctaccagactcccgtgctgtgtctcgtggcgaggacgggccaccataccaactgacaacgccagaccagtagttcgttttacacgtacggtaccaaacaaagtaagtaacttacgttcgtacgtttacgtaccagacaagaaaccgaggaccgacgccttacgtaaggttcgactacttaacgtttaccgtacgggactacgtacccggtacccggggtaccggttccccgggtacccgtaccggtacccgtagtaccgacggaccggtacgtacggtccggggtactacggaacgtacgtaacggttacttactaccgtacctaccaaccacgtacacgactaccgtcgtacgacgacggtacgtagaacgtagttgacggtaacttagttttacttacggtagtacagtaaccttaagttatttaagttcgtttaccgtaccttaggttaaccggtttacgggtttaccgggaacccggggtaactaaggtccggttaggaaccgttaagtaccgtaacggttaactacggttaccggacctacgaacctacgtacgttccggttactttaccgttaccctcgttacccccg

SEQ ID NO: 4596 - DNA, 568 bp, Homo sapiens
  misc_feature: GYAE6OF02GRR1M.39.31.C09.1.454.CMB.1.raw
  modified_base (345)..(345): a, c, t, g, unknown or other
  misc_feature (345)..(345): n is a, c, g, or t
  modified_base (417)..(417): a, c, t, g, unknown or other
  misc_feature (417)..(417): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagtgctcatttactgggcatctacccgggagtcccggggtcctgaccgattcgagcggcaggcggtcngagacagactttcactctcaccatccagcagcctgcaggctagaagatgtgctagtttattacgtgtcgagntagttacttagtacgttagtaccgttctaagtcgttttcgggacccggggtacgaaggtcgtagggacgtagtaccgaaacggtaacgtacggtcggtaccgtacgacctaacgtacgttaccgttcgtacctttaccgtactttaccccg

SEQ ID NO: 4597 - DNA, 781 bp, Homo sapiens
  misc_feature: GYAE6OF02H8XC9.39.31.C09.1.454.CMB.1.raw
  modified_base (556)..(556): a, c, t, g, unknown or other
  misc_feature (556)..(556): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagacctccctggctgtgtctcgtggcgagaggccaccatccaactcgacaacgaccacggaccaagtacgttacggtttttaaccaacgtacgggttacccaaaactaaaagttaaaaggtaacttttaaccgttcgtaccgtttacggtaacccaaggacaaacggaaaaccgaaggtaaccgacgtaccgtaccttaaggttacgtcctacttaactttacggtcggtaacctaacgttacccgtaacccgggaccggttccccggggtcccgtaccgtaccgtaacgtttccgaacggccggaccgaggtaccgggtctacggacggtaactagttactttcaacccgttctacccaaactactacgaagtaccacgtccgtagacggacggtagaagtaaacgngttaggtcgactttaacggttaattaccgttaggtacaacgtcggttaattaagtttagtacggttaaccgttacctaggtaaccgtttacgggtttacggggacccggggtaaactaacggtttaccgagggttactactaaaccgggtaaactaggttccggtacgacggtacgaacccgttacttcctaacggttcttacccgttcttacgggtttaccccc

SEQ ID NO: 4598 - DNA, 800 bp, Homo sapiens
  misc_feature: GYAE6OF02HXDKQ.39.31.C09.1.454.CMB.1.raw
  modified_base (178)..(178): a, c, t, g, unknown or other
  misc_feature (178)..(178): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatgacccagtctccagacctcctggctgtgtctcgtggcgagnggccacatcaactgacaagtaccacgccagtagttacgttttaacacgacggtaccaaactaaacgtaagtaactttacttcgtcttacgggtaccaggacgtaacgaaaaccgaggaaccacgtaccctaccgttaaagttcgacttacgttaacgtttaccgtagggctaaccgtaccggtacccggggtacggttccccggggtccctacggacccgtatttccggacggtccggacgtacggtccggtactcggaacgtacgaaggttacctttacgacctaccgtacccaaccgtagttaccgaacgtacgacccgtccggtacgaccgtacggtaccgtaacggtaacgtacggttcgggtaacggtaccgtttaaggttttaaaccgtttacgttacggtaacgtacggttaccgtaaaggtttaacttaaagttaacggttaccgttacgttaccgggtaacgtttacgggttttacccggggaacccgggggtaacgttaacggtaccgggttacgacggtaacgttaacccggtaaacggtaacggttcggtacggtaccgtctaaccgtactaccgttaccgttcctttacctacgttaccctttaccccg

SEQ ID NO: 4599 - DNA, 1070 bp, Homo sapiens
  misc_feature: GYAE6OF02FXMDV.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttcgttttacacgtacggtaccaaacaaataaagtaaatttaaccgttaccgtccgtttacggttaacccaaggacctaaggaaaacccgaagggaacctaaggtcccctaacccgttaaaggtttcgccttactaagttttaccgtagggggacctaagttccccggtaaccccggggtaacggttcccccgggggtttacccccgtggtaaccccggaattttccgaacgggtcccgggtaccgtaacgggtcccggggttaccgtaggtaaccgggtaacctaacggttaacttttaccccgtaaacgtttccggtaacccctaacccgtaacgtttacccgaaaccgggtaccctaaccgggtacccgtttcggaacccggtaacggggtaaccgttaacgggaaacggtaaggtttaccgggttaacgggtacccgggtttaaaggttttttaaaccggttttaaaccggttttacggttaaccggttaaaccggttaaccgttaaacgggtttaaaaccgttttttaacggttaaccgggttttaaaccggtttacccccgtttaacgggttttaaaccccggggtttaaacccggggttttttttaaccccgggggggaaaccccgggggggttaaaccccttaaacggggttacccggttaaacgggggtaacggtttaaacccggttaaaacccggtaaaaacccgggtttaaacccgggttaaaccgggggtttaccggttaacccggtttaaccggtaaacccccggttaaacccgttacccggtttaaaccgttttacccggttttaccgttttaaccccgttaaccgtttttaaccccccccgggg

SEQ ID NO: 4600 - DNA, 549 bp, Homo sapiens
  misc_feature: GYAE6OF02JG0H6.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttacacaggtccaacaataagaattactcgcttggtaccagtcagaaaccaggacagcctactaagttcgctctattactggcatcgtacccgggagtccgggtacctcgacgacttcgagcggcagcggtctgacgacagtactttcaactctcgactatcagcagcctcgcacgctagaacgatcgcgactagtttatactgactagcctagtatacgtaagtacgtcctacgagttagtttacgggccggggtaacaaagtccgtaggactacgtagaacgtaactagcggtacgtcgacctaccgtacgtaccttgtacctttacacttcccg

SEQ ID NO: 4601 - DNA, 886 bp, Homo sapiens
  misc_feature: GYAE6OF02G3LRE.39.31.C09.1.454.CMB.1.raw
  modified_base (345)..(345): a, c, t, g, unknown or other
  misc_feature (345)..(345): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagacgggccaccatcaacgtgacaacgtccagccagtagttgtttaccacgacggtaccaaactaagtaaagtaacttaccttcgtccgttacggtaccaacggaccaaacggaaaccaagggaacctacgtacccttaccttaaggttcgcttacctagtttaccgnggggacctacgtaccggttaccccggggacggttccccggggttaccctggaaccgttactacgacggtccggacgtacggtccggtctgacgtacgagttaactttccgacgttcctaccactactacgacgcctaacgtccgtacgacgtacggtacgtaaggtacgtacgttacgggtacggtaactttaacggttttaacctttaccggttcgtttaaccggtaaccggttaacgttaacggtttaacgttttaacggttacggttaaccgttttacccggttaaaccggtttaccggggtttaaccgggttttttacccggggggaacccggggtttaaacccggtaaaccgggttaaccgggtttaacggggtaacgttaacccggtaacccgggtttaaaaacccgggttacgggttacccgggttaacggggttacccgttaacccggtacccggttaaccggttaacccgttttacccggtttaacccgggttttaccctttttacccggttacccgttttacccccccggg

SEQ ID NO: 4602 - DNA, 594 bp, Homo sapiens
  misc_feature: GYAE6OF02FR638.39.31.C09.1.454.CMB.1.raw
  modified_base (403)..(403): a, c, t, g, unknown or other
  misc_feature (403)..(403): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatggacccagtctccagactccctggctgtgtctcgtgggcgaggagggccaccatcaactgcaagtccagccagtagttgtttacacaggtaccaaataataaagaacttacttcgcttggtaccagcaagaaaccaggacaacgcctacctaagttgctctatttacgtgggcatccgtaacccggggtcggtcccggggttcctacggaccgtattcgaggcggcaggcggtctgagcagtacttcactactcacatcgagcganccgtgacgtggctaggaacgagtcggtaggtctaagtttacttcgtgtcgatcgtaagttattagttacgtactacctcgtacgtttcgtttcgggtaccggggaactacggtacgtggaacgttagaccgtaaacggtgtcgggtactcgtacgactacgtactcgttaccgtcttaccggtattccccg

SEQ ID NO: 4603 - DNA, 639 bp, Homo sapiens
  misc_feature: GYAE6OF02HYYOA.39.31.C09.1.454.CMB.1.raw
  modified_base (224)..(224): a, c, t, g, unknown or other
  misc_feature (224)..(224): n is a, c, g, or t
  modified_base (399)..(399): a, c, t, g, unknown or other
  misc_feature (399)..(399): n is a, c, g, or t
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgaccagtctccagactccctggctgtgtctctgggcgagagggccaaccatcaactgacaaggtccagccagagttcgttttaacncaggtacccaaacgaaacttaaagaaatttacttcgtacttaggttaccagcaaacgaaaaccaggaacacgcctacgtaacgttgctactatttacgtagggcaactccgtaaccggggtacgtcccggggtccctcggaccgaattcgaggcggcaggtcggtactgaacganagtactttacacttcaccacgtactacacgacgacgtcctgactaggcgtaagtaagagttggtacgacgttagtttaacttacgtacgtcgaacgtcgtaagttagttaagttaacgtcgttacctagtaacgttacgtttcggggaccgggaaaccgaagtcgtaggtacgtacgtaacaaacggtactcggtaggtctacgactaaccgtacttacgtacgttacttccacttcccg

SEQ ID NO: 4604 - DNA, 634 bp, Homo sapiens
  misc_feature: GYAE6OF02F3TQC.39.31.C09.1.454.CMB.1.raw
  modified_base (320)..(320): a, c, t, g, unknown or other
  misc_feature (320)..(320): n is a, c, g, or t
  modified_base (441)..(441): a, c, t, g, unknown or other
  misc_feature (441)..(441): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagactccctggctgtgtctctgggcgagagggccaccatcaactgcaacgtccagccagtagttcgttttacacgacggtaccaaacaataaagtaacttacttcgtcgttacggtaccagacaagaaaccaggaaccacgtccttacctaagttcgctactatttacgngggactacgtccgtacccgggacggtcccggggtccctcggaccgtattcgacggtcggacgacggcgggtctaggacgactagtactttcacttcacaacctatccagcacgtctcgcgngacgtagaagtgtggtgtacgtaagtttattacgttgtactagtctaagttattaagtacgttacgtacctacgtaacgttcggtttacgggaaccgggtaactacggacgttagggacgtacctaacggtaacgtaccggtggtacggtcgtacgacctactacgtaccgttcgtccgttactacttccccg

SEQ ID NO: 4605 - DNA, 553 bp, Homo sapiens
  misc_feature: GYAE6OF02FVMNS.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcaggcaagatggtgttgcagacccaggtcttcatttctctgttgctctggatctctggtgcctacggggacatcgtgatgacccagtctccagactccctggctgtgtctcgtggcgagagggccacatcaactgcaagtccagccagagttgtttacacaggtccaacaataagaattactcgcttggtaccagcagaaaccaggacagcctactaagttcgctcatttacgngggcagtcctacccgggagtcccgggtcctgaccgtattccaggcggcaggccggtctggacgacagtactttcacctctacacctagtaccagccagcctgcgacggctagaagtgtgtacggtctagttattacgtgtactagcgtagttattatagtacgtctctagttacgtttcgggaccgggtacaggtcgtaggacgtatacgaacgtacgtagtcggtctgacctactctccgttgtccttactacttcccg

SEQ ID NO: 4606 - DNA, 601 bp, Homo sapiens
  misc_feature: GYAE6OF02IZW4Y.39.31.C09.1.454.CMB.1.raw
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccctggctgtgtctctgggcgagaggccaccatcaactgcaacgtccagccagagtgtttacacaggtccaacaaataagaattactcgcttggtaccagtcaagaaaccaggacagcctacctaagttgctntatttaacngggcatcgtacccgggagtcccggggtcctgaccgattcagcgnacgnggtctgagacngatttcgactctcacatcagcacgtctgccaggctggaatatggtagactagtttactagttgtcaggtctaagtatagtagtacgtcctacgtacgttacgtttcggggaccggggttaacctaaaggtccgtaagggtacgaacgttaccgaaaaaccggttcgttacgggtaccggaacgttaccgacccgttaaacctcgtttacccggtacgtttcccgttaacggtccctttaaccccg

SEQ ID NO: 4607 - DNA, 954 bp, Homo sapiens
  misc_feature: GYAE6OF02IDO8M.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgccgtacgggacatcgtgatgacccagtctccagacctccctggctgtgtctcgtgggcgaggacggcccacctatacaactgacaacgtccagccagtagtttacgtttacacgtacggtaccaaactaaagtaaagtaactttacgttccgtacgtttacgggtaaccacggaccgaaaaccggtaaaaacccgagggaacctacggacccctttaaccgttaaacggttcgaccttaccttaagttttacccggtaggggtacctaacggttaccccggtaaccccgggggtaccgggttacccccgggggtcccctaaccggtaacccggttacgttaccggacgggtacccggggtaccggtaaccgggtcccgggggttaaccgtacggaaacggtaaccgtaacggtttaacttttacccctaacccgtttacccgtaccccgtaacccgtaagtacccggtaacggaccgtaacccggtacccgttagggacccgtaaacggggttaccgttaaagggaaacgttacgggttacgggttaccgggaacgtttttaagggttttaaacctttaacggttacgggtaacctagggttaaccttaaaggttttaaacctttaagttaaccggtttaacccgttaccgttaacgggtaaccggttttacccgggtttaccggggggaacccgggtaaacctaacgggtcgttaacggggaaccttacggtaaaccgtaaaccggttcggttacggttaccggtaccgttaaccgtacccgtaaccgttacgtttaccgtttacgttccctttaccgtaacccgttttcccccgg

SEQ ID NO: 4608 - DNA, 617 bp, Homo sapiens
  misc_feature: GYAE6OF02HBOLZ.39.31.C09.1.454.CMB.1.raw
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (412)..(412): a, c, t, g, unknown or other
  misc_feature (412)..(412): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagttgttttacacaggtaccaaacaataaagaattacttcgcttacggtaccagacaagaaaccaggacacgcctacgtaagttgctgtaatttcgnggctactccggtacccgggacggtcccgggtcctgaccgtattcgaggcggcaggcggtntaggacganagtatttcgactctacacctatacgacgcacgtccgngacgacggtactaggaacgtagttcggtacggtacttaagtttacgttagttacgtacgacgtagtagttaattactacgttacgttcctaggtacgttaccggtttcggggaccgggtaacgtacggtacgtagaacgtacgtaacgtaaacgtcggtaggcggtacctgaccacgttcgttcgtcgttacctacgtcttaccg

SEQ ID NO: 4609 - DNA, 709 bp, Homo sapiens
  misc_feature: GYAE6OF02FSYKL.39.31.C09.1.454.CMB.1.raw
  modified_base (130)..(130): a, c, t, g, unknown or other
  misc_feature (130)..(130): n is a, c, g, or t
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgccgtacggganatcgtgatgacccagtctccagacctccctggctgtgtctctggcgagagggccaccatcaactgcaagtccagccagagttgtttacactaggtaccaaanaacgtaanaatttacctcgtacgttcggtaccaagcaacgaaaaccgtagacagacccttctaaaggttgctacgtacttttacgcgggtactacgtacctacccggggaggttccccgggtttccgacggaccccgtattacgacggtcccggacacgggtcggtacctaggaaccggtacgtaacgtattttaccaccgtttccgtacctaaccgaattccgaaacggtccgtaacgtcccgttacggtacccgaacggtccgtacggtaacggtagtacggtgtacccgttaagtttacgtttaccgttacgtctaacgtcgtaagttagttaacgttaggttccgttacctacgtacgttacgtttacgggcccggggtaactacggtacgtacgagttacgtaacgaaacggtgtacgtacggtacgttacgaccgtaccgtcttaccgttgtaccctttacgtcttacccg

SEQ ID NO: 4610 - DNA, 644 bp, Homo sapiens
  misc_feature: GYAE6OF02HDN8A.39.31.C09.1.454.CMB.1.raw
  modified_base (320)..(320): a, c, t, g, unknown or other
  misc_feature (320)..(320): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcggtgatgacccagtcctccagacctccctggctgtgtctcgtgggcgaggacgggcccaccatacaactgacaagccacgccagagttgtttacacgaggtaccaaacaaataaagtaactttactcgtacgttggtaacccagacaagaaaccaggaacagcctactaagtcgctactatttacgnggacacgtccgtaacccgggaggtccccgggtaccctacgaccgtactgaccgcggacgacgggcggtactggaacgacagttntttccgactctacaactntcgaagctacgcctgactacgggactaaggaagattggcggtacttagttttactagtcgtacagacgtaagttaataagttagtacctacctagtacgttacggtttccggggacccgggtaacaaacggtcgtaaggacgtactaacgtaaacggtaacgtcggtggtaccggtacacccggtaactacgttcgttacgtttcctccgtactttaacccg

SEQ ID NO: 4611 - DNA, 606 bp, Homo sapiens
  misc_feature: GYAE6OF02I49I7.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataagaattacttacgcttggtaccagcaagaaaccaggacagcctacctaagttgctctatttactgggcatccgtacccgggagtccggggtccctcgaccgattcaggcggcaggcgggtctaggacgacgtagtatttcacttccgtacacctactaccagaccacgcctgaccgaggccttaggaagtagttggtaggtacttacgttttattacgttagtcagacgtagttacttatagttacgtccttacacgtcgttttacggggacccgggtaacgtacggtcgtaggacgtacgtacgtaaacggtaacgtaggtcggtactcgtaccgtacctacgttcgttcgttacttccgtactttaccccg

SEQ ID NO: 4612 - DNA, 772 bp, Homo sapiens
  misc_feature: GYAE6OF02HUYGM.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctggcgagaggccaccatacaactgacaagtccagccagtagttacgttttacacgtacggtaccaaacaataaagtaatttaccgttcgctttggtaccaggccaaacgaaacccgaggtaccgacgccttaccgttaaaggttcgaccttactacgttttacggtcgggtacctaacggttacccggtacccggggtacggtttccccgggggtaccccttacggacccggtagtttaccgacggccggtacgacgggtccgggtactgaacgtacgtagtactttaccaccttaccaccgtaacctactccaacgtaccgacgtcctacggaccgaacggtcgtacgaaggtatcgggtaaggtcctttaaggttttacttaccgttagtacgtacggtattaacgtatttacgtaacgttaccgttaccgttagttaacggttccggtttaaccgggggacccgggttaaccgaggtaccgtaagggtaccgttaacgacccgggttaaaacgtaccggttgggtaccgggaaccttaacggaaccctacggttaacgtccgtttaccggtttaacccgtttcctacccgtttaccccgg

SEQ ID NO: 4613 - DNA, 552 bp, Homo sapiens
  misc_feature: GYAE6OF02GJBKK.39.31.C09.1.454.CMB.1.raw
  modified_base (388)..(388): a, c, t, g, unknown or other
  misc_feature (388)..(388): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactgcttggtaccagcagaaaccaggacagcctcctaagttgctcatttactgggcatctacccgggagtccggggtcctgaccgatcagcggcagcggtctgacgacagactttcgactctcaccatcagcagcctgcaggcctaggaanagtcgtaggtctagtttattacgttgtctaacgcgtagtattaactagttaagtccgttagtagtaccgttttacgggccggggtaccaaggactacgggagtagtaacgtaacggtaactacggtcggtacgtgtacgtacctagtctcgtcttcacttcccg

SEQ ID NO: 4614 - DNA, 801 bp, Homo sapiens
  misc_feature: GYAE6OF02FL6B6.39.31.C09.1.454.CMB.1.raw
  modified_base (697)..(697): a, c, t, g, unknown or other
  misc_feature (697)..(697): n is a, c, g, or t
tcagtcgcactagtcacgaccggtgctcgatttagacgtctcatcaaggaaggaagggggcacgcaacgagtggttgttggctagaccctaggtcttcatttctctgttgctctggatctctggtgccttacggggacatcgtgatcgtacccagtctccagtactccctggctgtgtctcgtgggcgagagggccaccatcgaactgcaagtccagccgagtagttgttttacacgacggtaccaaacaataaagtaactttacgttcgtactttcggtaaccagacaacgtaaaaccagggaaccacgtccttaccgttaagttcggaccttactaagtttaccgtcgggacctaagttccgtacccggggtacggttcccggggtccctggaacccgtattccgaggtcgggacgtacgggtccgggttcgtagggacgtaactacgttaactttacccgacgttcctaccgtaaccctaacgtacgaccggtaccgtaacggtcccgttaggaccgaagggtccgtaaacgggtaaacggttactttaggggtacggtttaaccgttaagtttttacctttaacgtacggtactaacggtacgttaaacggtttaagtttacgttaacggttaaccgttaccgttaccggtaaacggttttaccgggtttaccggggggacccggggttaaanacggttcgggtagtaacgtacgtaacggtaaccggtacggtggttaccggactacgggacctaaccgttcttaccggttacgtttccttacgtacctttccccg

SEQ ID NO: 4615 - DNA, 619 bp, Homo sapiens
  misc_feature: GYAE6OF02FXF1P.39.31.C09.1.454.CMB.1.raw
  modified_base (254)..(254): a, c, t, g, unknown or other
  misc_feature (254)..(254): n is a, c, g, or t
  modified_base (311)..(311): a, c, t, g, unknown or other
  misc_feature (311)..(311): n is a, c, g, or t
  modified_base (374)..(374): a, c, t, g, unknown or other
  misc_feature (374)..(374): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggcatcgtgatgacccagtctccagactccctggctgtgtctctgggcaggagggccaccatcaactgcaagtccagccagagttgttttacacaggtccaacaataagaattacttcgcttgtaaccngacaagaaaccaggacagcctactaagttgctctattcgtggctatccgtaccgggnggtccgggtccacgaccgattcgagcggcaggcggtctgacgacagtatttcactctacacancacgtcagcctgacgaggctaagaacgtagtcggtggtactaacggtttatttaacgtggtactacgactacgttaagtttataacgttacgttaccgttacgtaagtttaccggtttacggggacccggggttaaccaaacgggtcgtaacgggacgttacgtaacgtaaaaccggtcgttacggtcggtacgttacggaccttaccgacgttcccgttattcccggttacttcttacccccgg

SEQ ID NO: 4616 - DNA, 696 bp, Homo sapiens
  misc_feature: GYAE6OF02JW4G3.39.31.C09.1.454.CMB.1.raw
  modified_base (176)..(176): a, c, t, g, unknown or other
  misc_feature (176)..(176): n is a, c, g, or t
  modified_base (186)..(186): a, c, t, g, unknown or other
  misc_feature (186)..(186): n is a, c, g, or t
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (308)..(308): a, c, t, g, unknown or other
  misc_feature (308)..(308): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgngagggccacntcaactgcagtcagccagagtntttaaacnggtaccaanaataagattactcgcttggtaccagcanaaaccgnggaacagcctctagttagctcatttacgtaggctagtccgtacccggnggtcccgggtccctgacccgagttcagccggtcagggtccggtacctggaacgactaaggtatttaccgtacaccgttcaacccgatcccgtaggaccacgtccccgttgacgacggtcgtaggtaacgagtaggtacggtagtaaccggttttaattaccgttgttaacgcggtaacgttacgttaagttacgttaacgttaccggttaccttaccggtacgttaaccgggtttccgggtacccgggggttaaccaacgggttaccgttaggtaacgtaaccggttacaaaccggtaacgtaagggttaccggtacgtacccggtacgtaacccgtacggttaccgttacgttttccgtaccgttaccgttacccggttaccccccg

SEQ ID NO: 4617 - DNA, 653 bp, Homo sapiens
  misc_feature: GYAE6OF02JC699.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactcccgtggctgtgtctcgtgggcgaggacgggccaccatcaactcgacaacgtccacgccagagttgttttaccacacggtaccaacaataagtaattacttcgtcttggtaccagtcaacgaaaccgaggacacgtcctaccctaagttcgctactagtttacgtcgggacagttaccgtacccgggtacggtcccggggtccctcgaacccggtattccgagccggcacggccggtctagacgtactacgtacgtttcactctaccacctactacgacgtcactccgtacgaccgtaggtctagggaacgtagtcggtcgtacgtatttacgtactgtacagtactagttatagtagtacgttcctaggttacgttcggtttaccggggaccgggtaaccacggttacgtaggacgttaagacccgtaacggttaaccgtgtaaccggtctacccggcctaaacgtcttacgttcgtttacccttcgactttacccccg

SEQ ID NO: 4618 - DNA, 623 bp, Homo sapiens
  misc_feature: GYAE6OF02IW6KY.39.31.C09.1.454.CMB.1.raw
  modified_base (299)..(299): a, c, t, g, unknown or other
  misc_feature (299)..(299): n is a, c, g, or t
  modified_base (418)..(418): a, c, t, g, unknown or other
  misc_feature (418)..(418): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaataagaattacttcgtcttggtaccagcaagaaaccaggacagcctctaagttgctactatttacgnggctacgtccgtacccgggaggtccgggtcctgaccgtattcgagcggcacggtcggtctgagacgagtactttcactctacacactacagcacgtccgtagacgacggtctagaagtntggtagacttaagtttacttacgttgtactagcttaagttacttaagtacgttacgtcctacgtaacgttcggtttacggggaacccgggtactaacggtcgttagggaacgtacgtaacggtaaacggtaacgttcggtacggtacctacggaccctaaccggttacgttaccgttaccgtttccttacgtaccgtttcccccg

SEQ ID NO: 4619 - DNA, 781 bp, Homo sapiens
  misc_feature: GYAE6OF02JGNXB.39.31.C09.1.454.CMB.1.raw
tcagtcgcactagtcacgaccggtgctcgatttagacgtctcatcaaggaaggaaggggcagcaagatggtgttgcagacccaggtcgttcatttctctgttgctctggatctctggtgcctacggggacatcgtgatgaccagtctccagactccctggctgtgtctctgggcgagacgggccaccgatcaactgcaacgtcagccagtatgttttacactaggtaccaacaagtaaagtaacttaacttcgtacttaggtaccagaccaagaaaccgaggtaaccaggtccctacgtaaacggttggtacctctaagtttacgtcgggacctacgtccgtaacccgggacgttacccggggtacccttcgaaccggtacttccgaacggtccggactacggtcgggtcctaggactacgacgtactttctaacgtctacgaacctatacacggtcacgtcctgacgagtcgtaagacgtatgggtcgtaccgtaagtttactacgttaggtaccacggttaacgtagttttaactaaacgtttaacggttaaccctttacccggtacccgttaacggtttacccgggtttttaaccgggggtaacccgggggttaaaccctaaggttaacccggtccggggtaaaacgttaccggttaaacccgtaaaacccggtttaaccgggttaacggttacggtacccgtacccgtaacgttaaccccggttaccgttaacgtttaccccggtttacgttaacccttaccggtttaaccccccgg

SEQ ID NO: 4620 - DNA, 640 bp, Homo sapiens
  misc_feature: GYAE6OF02F5SV9.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacacggtaccaaacaataaagaattacttcgcttggtaccagacaagaaaccaggacagcctactaagttgctcatttacgtgggctacgtccgtacccgggtaggtcccggggttccctcggaaccgtattccgacggtccggacagggtccgggttctacggaacgaccgaaggtacttttaccgaccttctaccaacctacactacgacaacgcctgacacggctagaacgtagtggtcggtacttaagtttattacgttgtacatactagttatttaatagttacgtaccttagtacgttacggttttacggggaccgggtaaccgtaacggtcgtaggaacgtagtaaccgaaacggtaacgttaggttcggtacgtcgacctacgtacgttcgttacgttcttacctacttccccg

SEQ ID NO: 4621 - DNA, 763 bp, Homo sapiens
  misc_feature: GYAE6OF02HKBGL.39.31.C09.1.454.CMB.1.raw
  modified_base (340)..(340): a, c, t, g, unknown or other
  misc_feature (340)..(340): n is a, c, g, or t
tcagtcgcactagtcacgaccggtgctcgatttagacgtctcatcaaggaaggaaggggcagcaagatggtgttgcagacccaggtccttcatttctctgttgctctggatctctggtgcctacggggacatcgtgatcgacccagtctccagtacctccctggctgtcgtctcgtggcgagacgggccacatcaacgtgacaagtccagccagtacgttcgtttacacgtacgtaccaaactaataacgtaacttactcgtcgttacggtaaccaggtccaaacgaaaccgaggtaacacgtacccttaccgtaagttcgaccgtacttattttaccgngggtactacgttccggtaacccggggtacggtccccggggttccctacggacccggttactttacgggaacggtccgggaccgtaacggggtccgggttacttagggaacgtactaggtttaactttcccgaccttcctaccgaacccgtagtaccgcggtactaccggtccgtccgacggtacgcgtaacggaactggtcgtacggtccttaagtttacttacggttctacgcggtacgttagttaccttagttacgttaccggttacgtacgttacgttccgggttttacccgggggaccgggttaaccgtaggtccgttaggtaaccttacgtaaccgtaaaccggttaagtacgggttacgaacgtttcggaacctcggttaactccggtttaccgtactttacccgtaccgttacccg

SEQ ID NO: 4622 - DNA, 789 bp, Homo sapiens
  misc_feature: GYAE6OF02H5PIH.39.31.C09.1.454.CMB.1.raw
  modified_base (382)..(382): a, c, t, g, unknown or other
  misc_feature (382)..(382): n is a, c, g, or t
  modified_base (701)..(701): a, c, t, g, unknown or other
  misc_feature (701)..(701): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacgggacatcgtgatgacccagtctccagactccctgtctgtgtctcgtgggcgaggacggccaccatccaacgtgacaacgtccaagccgtagtagtttacgttttaaccaagtacggtaaccaaaacaaagttaaagtaaacttttaccgttccgtacgttttacggtacccaacggaccaaaacggaaaacccgagggaacctacggtaccccttaccggttaaagttcgtaccttacgttaacttttacccgggngggtacctaacgttacccgggtaaccccggggttaccggtccccgggggttaccctaccggaaccgttaacgttccgaacggtccccggacggtacgggtccggggtactacgggtaacgaccgttagttaaccttttaccgaccttcccttaccgaacccgtataccgacgaccgtaacgtcccgtagaaccgtcggtaccgtaaaggaaggttagttcgggtagttaccgttaaggttttactaccgttgtacctaaggtattaagttatacgttagttacgtttccacgttaggttccggttcggggacccggtanacgtcggtagaactagtaaccgtaacgtgtacggtctcgtacgccctacgttaccgttacgttccgtacttcccgttacgttaccccg

SEQ ID NO: 4623 - DNA, 800 bp, Homo sapiens
  misc_feature: GYAE6OF02JBD5E.39.31.C09.1.454.CMB.1.raw
  modified_base (774)..(774): a, c, t, g, unknown or other
  misc_feature (774)..(774): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtcctccagacctccctggctgtgtctcgtgggcgaggagggcccaccagtcaactcgacaacgtccacgaccgtagtagttacgttttaccacgtaacggtaccaaacgtaaataaagtaacttaccttacgcgttacggtaaccagtaccaaacgaaaaccacgggtaaccaacgtacccttaccgttaaaggttcgaccttactaacgtttacggtacgggtactacgttacccggtacccgggtaccggttcccggggtccctaggacccgtactacgacggacggcgacggtccggtctaggaacgtacgtagttactttacccgacttccgacctaacccgtactccgaacgcctaacggtccctacggaccggtacggcgttaacggaagtacggttcggtacgggtacttaaacggttttaactttcgtacggttacctaggtaaccttaaggtttaatttaaccggttaacggtttaccggttacctaaccggttaggttttacccgggtttaaccgggggacccggggttaaacctaacggtcggtaacgggtaacgtaccggtaaacctaaacgggtaaccgttggtaccgtcgaaccgtaccgtccttaagtcccggtntttaacccgtctaccccttaccccgg

SEQ ID NO: 4624 - DNA, 671 bp, Homo sapiens
  misc_feature: GYAE6OF02JB1VB.39.31.C09.1.454.CMB.1.raw
  modified_base (304)..(304): a, c, t, g, unknown or other
  misc_feature (304)..(304): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccacatcaactgcaagtccagccagagtatttacacaggtccaaacaataagaattactcgacttggtaccagtacaagaaaccaggaccaggtccctaccttaagttcgctctaatttaccgngggctatccgtacccgggagttcccggggcctgaccgattcacggccgngaacggnggtctaggacgtacgatacgtttacacttcaccgtactatccaaggtccaacgtccctccgacgacgggtctaggaagtaaggttcggtacgtacgttaacggtttactttaacgtacgtcgtagtacgttagttaatacgttagtacgtttaccctacgttaacgttaccggttttacggggacccggggtaactaaacggtccgttagggaacgtaccgttaaccggaaaaccgtacggttaccggagggtacctaccggtacctacgtaaccttccgttacgttcccttaccgtaccgtttaccccgg

SEQ ID NO: 4625 - DNA, 569 bp, Homo sapiens
  misc_feature: GYAE6OF02GUFP9.39.31.C09.1.454.CMB.1.raw
  modified_base (504)..(504): a, c, t, g, unknown or other
  misc_feature (504)..(504): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgttttacacaggtaccaacaataagaattacttcgcttggtaccagcagaaaccaggacagcctacctaagtgctctatttactgggcatccgtacccgggaggtcccggggtccctgaccgattcgagcggcaggcggtctgacgacagtactttcactcacacatcagcacgcctgacaggtctagaagatcgtggtactagtttattactcgtacagactaagttacttagttagtacgtccttcgtagtttacgtttacggggacccggggtaacaaggtcgtagganacgtacgaaacggtacgttggacgtactcgaccaccttagttccgtgttcttacgtacttccccg

SEQ ID NO: 4626 - DNA, 614 bp, Homo sapiens
  misc_feature: GYAE6OF02HJDGL.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcaagaaaccaggacagcctcctaagttgctcatttacgnggcatcacccgggagtcccggggtccctgaccgattcaggcggcaggccgggtctggagacagtacttttcacgttctacaccatccagcagcctgcgaggtcctagaagtatggtggtacttaagttttattacgttcgtcgtagacgtagttaatttaagtaagttacgttcctacgtacgttacggttttcgggacccgggggtaaccgtaaggtaccgttagggaacgtacgtaaccggtaaaccggtaacgttacgggttacggcgttacgaccgtaccgtacttaccgtttacgtacctttctacctttccccg

SEQ ID NO: 4627 - DNA, 717 bp, Homo sapiens
  misc_feature: GYAE6OF02GC2SD.39.31.C09.1.454.CMB.1.raw
  modified_base (431)..(431): a, c, t, g, unknown or other
  misc_feature (431)..(431): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgaccagtctccagacctccctggctgtgtctcgtggcaggacggaccactatcaactgacagtccacgccagtagtttcgtttacacgacggtaccaaacgaattaaagtaacttaccttcgcgtttacgtaccagaccaaacgaaaccgagaccgacgtacccttaccgttaaggtgacgttactaacgttttacgcgggtactaacggtccccggttaaccgggtacgggtccccgggttcctaggaacccgttacgtcgaagggccccggtataaccgggccgggtttancggtaacggacgtacggttactttacgaccgtacctacgaacccgtactacgaacgtacctacgctacgaccgtagtaccgtaagtaacgtacgtaggtcgtaacgtttacgtttaacgttcgttacgtacttaggacctaaggttactttaacggtcgtaccgtacttcggtaagttccgggtttaccggacggtactagccgttagacgtagtaaccgaaacgtcggttacgtacggtcgaccgtactaccgttagtcgttacctttctaccgtccttacccgg

SEQ ID NO: 4628 - DNA, 655 bp, Homo sapiens
  misc_feature: GYAE6OF02JOXYH.39.31.C09.1.454.CMB.1.raw
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (399)..(399): a, c, t, g, unknown or other
  misc_feature (399)..(399): n is a, c, g, or t
tcagtcgcactagtcacgaccggtgctcgatttagacgtctcatcaaggaaggaaggggcagcaagaatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttacacaggtccaaacaataagaattacttcgcttggtaccagcaagaaaccaggacagcctcctaagttgctntaactttacgnggctatcgtacccgggagtccccggggtcctcgaccgtattcgaggcggacaggcggtctgacggacctagtactttccgacttcctacaccactccganccgtaagcccttcggacgtacggtactacgtaaaggtaacgttcggtacggtacgttaagttttacgttacgttacgttacgtaggtaccgtaagttaacgtttactaaggttacttaccgttacacggttacgttttacggggacccggggtaactaacggtccgtaggtaacgactaacgaaacggtaccgtaggtcggtaccgtaggacctaaccgtactaccgtttggtaaccctttcgaaccgtttacccg

SEQ ID NO: 4629 - DNA, 680 bp, Homo sapiens
  misc_feature: GYAE6OF02HVG14.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggcccaccatccaactgcaagtccagccagagttgttttacacaggtaccaaacaataagaattacttcgcttaggtaccagacaagaaaccaggaacacgcctacctaagttcgcttcagttttactgggacacgtccgtacccggggacggttccccggggtaccctcgaccgtattcgacgcggcgacggcgggtctggacgacagtactttcactcctcaaccatcacgcacgtcctgcaggctaaggaatagtggtacgtacgttagttttaactacgttcgtacgagtcgtaagttatttaagtagttacgttcctagtaacgtttacggtttacggggacccgggggtaactaaacgggtcgttaagggacgttaacgtaacgtaaaaccgggtaacgttacggggtacggtaccgttaccggaccgttaaccccgttaacgtttaccgtttaccggttttaaccttttacccgttaccctttacccccggg

SEQ ID NO: 4630 - DNA, 632 bp, Homo sapiens
  misc_feature: GYAE6OF02IFLRZ.39.31.C09.1.454.CMB.1.raw
  modified_base (298)..(298): a, c, t, g, unknown or other
  misc_feature (298)..(298): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgtttacacgtaggtccaaacaataagaattacttcgcttgacctagacaagaaaccaggacacgcctacctaagttgctactattacgnggcatcgtacccggtacgtccgggtcctcgaccgtattcgacgcggtcacggtcggtctgaacgacacgtatttccaactccgtactaccgactacgacgccgtacgccgtacgcgacggtctacggaagacgtggtacggtacgttaagtttaacgttacttcgtacagtacctagttaagttacttaagttaccgtaccgtacgtagttacggttttccggggaccggggtaaccaggtccgtagaacggtaccgtaacgaaacggttacgtaggtacggtactacgaccgtacctaactccggttaacgtttccttaccgttctaccccgg

SEQ ID NO: 4631 - DNA, 632 bp, Homo sapiens
  misc_feature: GYAE6OF02HMYJ2.39.31.C09.1.454.CMB.1.raw
  modified_base (333)..(333): a, c, t, g, unknown or other
  misc_feature (333)..(333): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaacgtccagccagagttcgttttacacacggtaccaacaaataagaattacttcgcttggtaccagacaagaaaccgagacagcctacctaagtgctctatttacgcggtcatccgtaccgggacgtcccggggtccncgaccgattcgaggccggcacggtcgggtctggacgacagtactttcgacctctaccaaccctatacacgtacacgtcctaggccgaggccgtaggacgtacgtggtacggtacttagtttattacggtcgtactaggtactagtttaacttaggttacgttagtccctacgtacggttaccggttttccgggacccgggaaccggtaacgcggtagggtacgtacgtaacgaaaccgtcgtagggtcgccttacggaccctacgtacgtccctttaggtccttaccttacttccccgg

SEQ ID NO: 4632 - DNA, 743 bp, Homo sapiens
  misc_feature: GYAE6OF02JWEVO.39.31.C09.1.454.CMB.1.raw
  modified_base (305)..(305): a, c, t, g, unknown or other
  misc_feature (305)..(305): n is a, c, g, or t
  modified_base (502)..(502): a, c, t, g, unknown or other
  misc_feature (502)..(502): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtcgggcgagacgggccaccatcaactgccaagtccacgccagagttgtttacacacggtaccaacaataagaattacgttcgtcttaggtaccagcaagaaaccaggacagcctactaagtgactctatttacgnggacatccgtacccggggacgtcccggggtccctcggtaaccggactttaccgacggtcggaccgtaacgggtccggggtactacggaacgaacgtacgttacgttttcccaacgttacctaccaacccgttactccgacggtactacgtcccgtcggaccgtacggacgtacggtaagtaggttacggtacgggtnttaaccggttttagttaaccgttcgttaccgacgggttacctaagtttaacgttaagttaacgttaccgttaccggtacgttaacggttacccgggtttttacgggggacccgggggttaaaccgtacggttaccgggtaggtaaccgtacgttaaccgtaaacccggtaacggttcggtacggtacggtacgtaccgtaaccgtcttaccgttcgtttacgttaccgtacgttacccccg

SEQ ID NO: 4633 - DNA, 879 bp, Homo sapiens
  misc_feature: GYAE6OF02JTU0Z.39.31.C09.1.454.CMB.1.raw
  modified_base (172)..(172): a, c, t, g, unknown or other
  misc_feature (172)..(172): n is a, c, g, or t
  modified_base (568)..(568): a, c, t, g, unknown or other
  misc_feature (568)..(568): n is a, c, g, or t
tcagtcgcactagtcacgaccggtgctcgatttagacgtctcatcaaggaaggaaggggcagcaagatggtgttgcagaccaggtcttcatttctctgttgctctggatctctggtgcctacagggacatcgtgagtcgacccagtcctccagacctccctggctgtgtctntggacgagacgggccacatccaactcgacaacgtccacgccagtacgttcgttttacgaccacggttacccaaaaccgtaattaaagtaaactttaccgttccgtacgttacgggttaacccagaccgaaacgtaaaacccgacggtaaccgaacggtaccccttaaccgttaacggttcggtccttaccgtatttttacccgagggtccctaacgttcccggttaaccccgggacggtttacccccggggtacccttaccggacccggtaaccgtttccgaacgggtccggaccgtacgggtccgggttaccgtggtaaaccggcgtaaacggttctttaccgaccgtttacacccgtacctaacgtccgaacgtccgaacgttccgctaacggngtacgtacgaaacgtcttaggtccggtaacgtttaacgttttacgttacgtcgtaaccgttacgagtttaacgtacgttaacgggtttaacgttaaccgttaccgttacccggtttaaacggttaccgttttaaccggggggaaccccggggttaaaccaaaggggtttacccggtaacgggttacgtaacccgttaaacgggtaaaaaccccgggtttcgttacgggtacccgggttaacgtttaccccggtaacttacccggttaaccgtttccggttttacgggttttacccttaacggttaaccccg

SEQ ID NO: 4634 - DNA, 809 bp, Homo sapiens
  misc_feature: GYAE6OF02GRZO8.39.31.C09.1.454.CMB.1.raw
  modified_base (742)..(742): a, c, t, g, unknown or other
  misc_feature (742)..(742): n is a, c, g, or t
  modified_base (788)..(788): a, c, t, g, unknown or other
  misc_feature (788)..(788): n is a, c, g, or t
tcagtcgcactagtcacgaccggtgctcgatttagacgtctcatcaaggaaggaaggggacgagcaagatggtgttgcagaccaggcttcattctctgttgctctggatctctggtgctacgggacgatcgtgatgaccagtctcacgactccctggctgtgtctcgtggcgagagggccacatcaactgacaagtccacgccacgagtcgttttacactacggtaccaaactaacgtaaagtaactttaaccgttacgtaccgtttacgggttaaccctacggtaaccgtaaggtaaaaacccgaaggaaccgaacggtaccccttaaccgttaaaacggtttggtaccttacttaaccgtttttaaccgtacggggaccttaagttacccgttaaccccggggaaccgtttaccccggggggtaccccttacgggtaaccccggtaagttttacccgaacggccggggttaccgaacgggtccgggggttaccttaggggaccggtaaaccgtacggttaacgtttttaccgaaaccggttccttaaccgaacccgtaacgttaccgaacggttaccaggtacccgtagaccgaaggtccgttaaggaaacgtgtcgtacgggtactaacggttttaattacgtaacggtctacggtacctagttaacgtttagtaaaggttccgtaccttcgtacgttaacgttttccggggaaccggggtaacaacggtcgtaggtanacgtaacgaaacgtaacggtcgtaggtcctgaaccgtccacgtttnggttacccttagccttacccg

SEQ ID NO: 4635 - DNA, 847 bp, Homo sapiens
  misc_feature: GYAE6OF02H4K5Z.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggacggcccaccataccaactgacaacgtccagccagtagttgttttaccacgaggtaccaaacaaataagtaactttaccttacgtcttagggtaccagacaaacgaaaccgaggaacacggcccttaccgttaagttcgacttactaatttaccgtgggacctacgttacccgtaacccgggggtacggttccccggggtacccctagggtaacccgtacgtttaccgacggtaccggaccgtaacggggtcccggggttcgtagggaaacggtacctaaggttacctttttaccgacccttccgtaacctaacccgtacttaccgaacgccaacggttccccgtaggaccgacgggtaccttaaagggaaaccgtaggttacgggtaccgggtacttttaaacgggttttttaaactttaccgttacggttactaacgggtaccttaaacggtttaactttaaagtttaaccggttaacgtttcccgttaaacgttaaccgggtttaaccgggttttaccggggggaaccccgggggtaacctaaacggggtccgttaacgggtaactaacgttaaccgaaaccggttaacgttacgggtacgtaccggtacgacccgtaccgttaacgttccgtttccgttaccgtttacacccgtttaccccg

SEQ ID NO: 4636 - DNA, 611 bp, Homo sapiens
  misc_feature: GYAE6OF02HLT07.39.31.C09.1.454.CMB.1.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaactaagaattactcgcttggaccagcagaaacccaggacagcctacctaaagttgctctatttagngggacatccgtaccccgggagttcccggggtcctcgaccgtattcgagccggcaggccgggtctggagacagtctttacacctctccaccctataccgacgtcaacgtcccgtagccgaacgggctaggaagtacgtttggtacgtacgttagtttaacgttacttcgtacgagtactaggttattagttaggtagtaccttacgagttacgtttacgggccggggtaacgaaggtcgtaggtaacgacgtaacaaacggtaaccttaggtacgtacgtcgtacgtaacctcgtcggttattccgttctacttcccg

SEQ ID NO: 4637 - DNA, 631 bp, Homo sapiens
  misc_feature: GYAE6OF02GLTWH.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatccaactgacaagtccagccagagttgttttacacaggtccaacaataagaattacttcgcgttgtaccagcaagaaaccaggacagccctacctaagttgcctctaatttacgtgggcagtccgtacccgggacggttcccggggtccctcgacccgtattcacggcggacgacggcgggtcgtaggacgaatagtactttccactcctacacccatccagccacgccgtgcacggtcgaaggaagtagtggtaggtacgttagttttacttacgttgtaccgtagacgtaagttattaagttacgttacgttacctacgtacgttaccggttttacggggacccggggtacgtaacggacgtaggtacgtacgtaccgaaacggtaacgtaggtcggtctaccgacctaccgtactaccgttcgttcttacctcttccccg

SEQ ID NO: 4638 - DNA, 641 bp, Homo sapiens
  misc_feature: GYAE6OF02GGHIR.39.31.C09.1.454.CMB.1.raw
  modified_base (318)..(318): a, c, t, g, unknown or other
  misc_feature (318)..(318): n is a, c, g, or t
  modified_base (474)..(474): a, c, t, g, unknown or other
  misc_feature (474)..(474): n is a, c, g, or t
  modified_base (484)..(484): a, c, t, g, unknown or other
  misc_feature (484)..(484): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctcagactccctggctgtgtctcgtgggcgaggacgggccaccactcaactgacaagtccacgccagaggttagtttacgacaggtaccaaacaataaagtaacttaacttcgtcttcggtaaccagacagaaaccaggaccacgtcctcgtaagttgctactatttaccgngggtacagtaccgtaccggacggtccgggtcctcgacgtatcacggcggcacggtcggttcagacgacgtagtactttgacctcgtacaacctatcgacgacgaacgccgtacgcgtaaggcgtaacgaaggtagtggtacggtacttaaacgttntttaacgtcncgtaagacgttagttaattagtacgtacgtcctagtactacggttttacgggaccgggtaacaacgtagtacggtaagtacgtaacgaaaccgtaggtcgttaacgggtctaccgaaccgtacctagttccgttaggttaccttacgtacgttcccg

SEQ ID NO: 4639 - DNA, 650 bp, Homo sapiens
  misc_feature: GYAE6OF02INHI0.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgaccagtctccagactccctggctgtgtctcgtgggcgagacgggccacgatccaactgacaagtccagccagagtagttttacacgaggtaccaactaataacgtaattacttcgtacttaggtaccacgacaacgaaaaccgaggacacgacctactaagttgctctaactttacgtggactataccgtacccgggtaggtcccgggtacctggacctattcgagcgcacggcggtcgtagagacgagtactttcgactactcaacactacgactccaacgccgtgacgaacggtcgagtaaagacgttgtacggtactaacgttttagtttaacgtagtaccgaacgtctaagttacttaattaagtacgttaccctagtacgttacggttttcgggaccggggtaaccgtaagaccgtaggtaacgtgtaaacgtaaaccggtacgttaggtaccggtactacggtacctacctaggttaccgttaggttccttaccgtacttacccg

SEQ ID NO: 4640 - DNA, 783 bp, Homo sapiens
  misc_feature: GYAE6OF02GEWO2.39.31.C09.1.454.CMB.1.raw
  modified_base (239)..(239): a, c, t, g, unknown or other
  misc_feature (239)..(239): n is a, c, g, or t
  modified_base (302)..(302): a, c, t, g, unknown or other
  misc_feature (302)..(302): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgaggacgggccaccataccaacgtgcaacgtccgagaccagacgttgtttaacacaggtaccaanaataagaacttaactgtacttaggtaccagtcaagaaaccaggacacgcctactaacgtttcnctatttacgtggctactccgtaaccgggtgtacccggggtcctaggacccgtagttcaggaccgcaggtcggtacctaggacgacaaggtcttaccacttaccgtcaaccctaatccgtaaacgctacgtaccgttaccggtcgaacggtccgtaaggtaacggtaacgtttggtaccgggacggttaacgtttttaacgttaccgttcggttaacgtaaccggtatttaacgggttaactttaacgtttaaggttaaccggttttaccctaagtttaaccggtttaccgggttttttaccggggacccgggggtttaaaccgaacccgggtacgttaacggggtaacgttaaccggttaaccgtaaaaacgggtaaccggttacgggtaccggttaacccggtcggtaaccgtaacccgtaaccgtttccgttaaccgtttacggttttacccttaacgtttccccgttttaacccccgg

SEQ ID NO: 4641 - DNA, 730 bp, Homo sapiens
  misc_feature: GYAE6OF02JYMSE.39.31.C09.1.454.CMB.1.raw
  modified_base (324)..(324): a, c, t, g, unknown or other
  misc_feature (324)..(324): n is a, c, g, or t
  modified_base (386)..(386): a, c, t, g, unknown or other
  misc_feature (386)..(386): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
tcagtcgcactagtcacgaccggtgctcgatttagacgtctcatcaaggaaggaaggggcagcaagatggtgttgcagacccaggtcttcattctctgttgctctggatctctggtgccgtacgggacatcgtgtatgacccagtcgtccagactccctggctgtgtctcgtgggcgagacgggccaccatctaacgtgcaagtccagccagtagtcgtttacacaggtaccaaactaataagtaacttacttcgtacgttggtacccagcaacgtaaaccgaggacaacgtcctaccgtaaagttgcctactaacgtttacgngggtacctaagtccgtaccggggtaacggtccgggttccgacgacggtattccgagtccggngtacggcggtctgaacgagacgtactttcacgttccnccgtaaaccngtacagtaccgacgtccgtaggtcgaacggtcgttacggaacgttaagttcggtacggtaccgttaacgttacgtttaaccgtgtttaacgacgtaccgttaagttacgttaaactttaacggtaacgttaccgtaccgtacggttaacggtttccgggtaacgggggtaacccctaaagttcggaacgggttaacgacgttaacgtaaaccggttaacggtactgggtaccttaccggaacccgttacgtaaaccggttccgtttaaccgtacccgttaccgtacgtttaccccgg

SEQ ID NO: 4642 - DNA, 707 bp, Homo sapiens
  misc_feature: GYAE6OF02HDHF5.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacgggcccacatcaacgtgacaacgtccagccagtagttgtttacacacggtaccaaacaataagtaattactcgtcgttacggtaaccagacaacgaaaccgaggacacgcctaccttaagttgactactactttacgcggctactaccggtacccgggtaggtccccggggtacctggaaccgtacttcgacggtcggacggacggtccggggtactacggacgacgtagttacttttaccaccgttacctaccaacccgtataccggaacgtaccgtaccgtcccgtacggaccggtacggtacgtaggtaaacggtacgtaggtacggttaacgtttaaggttttacttaccgttaggttactaggtacttagttaaacttacgttaacgtaccgttacgtacgttagttaccggtttcgggaaccggggtatacggtacgaggtacgacgtaacgtaaccggagtacggtcgtacgtcgacctaccgttacgttccgttacgttccttacgtaccgttaccccg

SEQ ID NO: 4643 - DNA, 564 bp, Homo sapiens
  misc_feature: GYAE6OF02I1HV6.39.31.C09.1.454.CMB.1.raw
  modified_base (211)..(211): a, c, t, g, unknown or other
  misc_feature (211)..(211): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttnttttacacaggtccaaacaataagaattactcgcttggtaccagcaagaaaccagaacagcctacctaagttcgacccatttactgggcatccgtacccgggagtccggggtccctggaccgattcagcggcaggcgggtctggagacagtatttcactctcactatcagcaacgcgtcgcgaggcgtagaagagtggtgcgttagtttattactgtcagtactagttacttatagtattccgtatagtacgtttacgggccgggtaaccgtagtcgtggacgagtacgaaacgtacgtaggtcgacgtcgaccacctacgtcgttacgtcctttactacgttaccgtccccg

SEQ ID NO: 4644 - DNA, 631 bp, Homo sapiens
  misc_feature: GYAE6OF02F03GO.39.31.C09.1.454.CMB.1.raw
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
tcagtcgcactagtcacgaccggtgctcgatttagacgtctcatcaaggaaggaaggggcagcaagatggtgttgcagacccaggtcttccaatttctctgttgctctggatctctggtgcctacggggacatcgtgatgacccagtctccagactccctggctgtgtctcgtgggcgagacgggccaccgatccaactgcaagtccagccagagttgtttaacacgtaggtaccaacaataagaattacttcgcttggtaccagacagaaccagacacgcctactagttagctactattacgnggcatccgtacccgggagtcccggggtcctgaccgattcgagcggnacgggtcggtctggagactatatttcactcacncatcganacgagtctntcgacgtcgtagaaggtatggtgtaacgttagtttagtttaccgtgtactaggctaagttacttaggttacttaacggttcctacgtacggttaccggttttacgggcccgggggttaacaaacgggtcgtaggaagtacgtaacgtaaaccggtaacgtacggttacggtacctacgtaccgtaccgttacgttaccgttcggtttaccgtttacctacccgtttaccccg

SEQ ID NO: 4645 - DNA, 680 bp, Homo sapiens
  misc_feature: GYAE6OF02HMDFM.39.31.C09.1.454.CMB.1.raw
  modified_base (220)..(220): a, c, t, g, unknown or other
  misc_feature (220)..(220): n is a, c, g, or t
  modified_base (450)..(450): a, c, t, g, unknown or other
  misc_feature (450)..(450): n is a, c, g, or t
  modified_base (497)..(497): a, c, t, g, unknown or other
  misc_feature (497)..(497): n is a, c, g, or t
  modified_base (520)..(520): a, c, t, g, unknown or other
  misc_feature (520)..(520): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtcgccgtacggggacagtcgtgatcgaccccagtcctccagacctcccgtggcctgtcgtctcgtgggcgaggcggcccaccataccacgtgacaagtccgancctagtgttgtttaccacgtacggtaccaacaaagtaagtaacttactcgtcgttacgaccagacaaagaaaccaggacacgtcctacgtagtcgtctacttagttcgcggtactaccgtaccggtaccgggacggttccccggggtacctcggaaccgtatcggagccgacggtacggtcgggtacaggtaactagtacgttactttacccacgtaccttccaacgtanaaccgcgccaaccgtcgtacgcgaacgtcgtagacgttagtgacgtntaacgtttagtcgtacgattaancgttaattacgtaagtaaccgtcttacgtacgtagttaccgggttaccgggaaccgggacctaagtccggtagacgtacgtaacgtaaccggagttacggttcgacgtacgaaccttacccgtattacccggttattcccggttactaccgttacccccg

SEQ ID NO: 4646 - DNA, 562 bp, Homo sapiens
  misc_feature: GYAE6OF02GBJF9.39.31.C09.1.454.CMB.1.raw
  modified_base (381)..(381): a, c, t, g, unknown or other
  misc_feature (381)..(381): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaaacaataaagaattacttcgcttggtaccagcagaaaccaggacagcctacctaagttgctcatttactggcatcgtaccgggagtccgggtcctgacgattcgagcggcagcggtctgagacagactttcactctcacatcagcagcctgcgngctagaagatgtgtctagtttattacttgtacgagtactagtattagttagtagtacctactacgtacgttttacgggaccgggtaaccacggtcgtaggagtactaacgaaaccggtaacgtgttacgggacgttacgaccgtaacctcgttaccgtcgttaccgttactacgttccccg

SEQ ID NO: 4647 - DNA, 618 bp, Homo sapiens
  misc_feature: GYAE6OF02IKN1R.39.31.C09.1.454.CMB.1.raw
  modified_base (136)..(136): a, c, t, g, unknown or other
  misc_feature (136)..(136): n is a, c, g, or t
  modified_base (297)..(297): a, c, t, g, unknown or other
  misc_feature (297)..(297): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgntaaagcccagtctccagactccctggctgtgtctctgggcgagagggccaccatcaactgcaagtccagccagagttgttttaacacaggtaccaaacaataagaattacttcgcttggtaccagcaagaaaccaggacagcctctaagtgcctatttacnggcatcgtaccgggagtccggggtcctcgacgattcgagcggacaggcggtctgagacagtatttcactctacacatcagcacgctgcaggctagaagatgtgctagtttacttatgttacagtatagttaattagtagttaacgtccctactacgttacgttttacggggacccgggggtaacctaaacggtcgttaagggtaacgtaacgttaaccgaaaacggtaaccgttagggtacggtaccgttacgtaacccgtaaacccgtagtttaccgttacggttacctttaccgttacgttaccccggtttaccccccg

SEQ ID NO: 4648 - DNA, 754 bp, Homo sapiens
  misc_feature: GYAE6OF02GIFHF.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctggatctctggtgcctacgggacatcgtgatgacccagtctccagactccctggctgtgtctctgggcgagcgggaccaccatcaactgacaagtccagccagtagtgttttacaaccgaggttccaaacaattaaagaactttaccttcgtactttaggtacccagacctaaacgaaaacccagggaactaacggtaccccttaccgttaaacggttcggtacctactaacgttttacgtaggggacctaacgttaccggttaaccccggggacggtttccccgggggttacccctacggtaaccggactttaccgaggtccggcgtaacgggccggttacgtagggtaacgtaccgaacgttacggttttacacggtttcctaccaaccgacgttacgacggtacctaacgtcccgtcggtacgtacggtccgtaaggtaaacggtagttcgggtacgggtacttacggttttaacgttacgttcgtacgtacggacttaagtactttagtacggttagtacctacgttaacgtcggttttacgggacccgggtacgtaacgtacggtacgtaacgtacgtaacgtaaccgtacgtcggtacggtcttacggccaacgttcgtccgttactcgtacctcttaccccgg

SEQ ID NO: 4649 - DNA, 671 bp, Homo sapiens
  misc_feature: GYAE6OF02F7OZ5.39.31.C09.1.454.CMB.1.raw
  modified_base (228)..(228): a, c, t, g, unknown or other
  misc_feature (228)..(228): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaanaataagaattacttcgcttggtaccagcaagaaccagacagcctacctaagttgctcatttacgtcgggacacgttccgtaccccggggacggtcccgggggtccctggaacccgtattcaggtcggcgaggccgggtctggacgacagtactttcacttcacgtaccaatccacgtaccacgtcctcgacgacggctaggaagtagttgtaggacgttaacgtttattaccgttgtacgtagtaccgtaagttactttaagttaggttacttaccgtacgttaacggttaccggttttcggggggaacccggggtaacctaaacggtcggtaacggtacgtaacgtaaaccgtaaaccggtaacggttccggtagggtcccgttacgaacccgtacttaacgtttaccgttaggtttacccgttaccctcgtttaccccccg

SEQ ID NO: 4650 - DNA, 792 bp, Homo sapiens
  misc_feature: GYAE6OF02HOZ30.39.31.C09.1.454.CMB.1.raw
  modified_base (378)..(378): a, c, t, g, unknown or other
  misc_feature (378)..(378): n is a, c, g, or t
  modified_base (423)..(423): a, c, t, g, unknown or other
  misc_feature (423)..(423): n is a, c, g, or t
  modified_base (515)..(515): a, c, t, g, unknown or other
  misc_feature (515)..(515): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgaccccagtcctccacgtacctcccgtggctgtcgtcctcgtgggacgaggacgggacccacctactaccaacgtcgactaacgtaccacgaccgagtaggtttacgtttacacgtacggtaacctaaacaagtaacgtaactttaccgttcggtcgtttacggtaccaaggtaccaaacgaaaccgaacggtacgaacgtccctaaccgttaacgtgtaccgtacttacgtttaccgngggtaccacgttacccggtacccgggtacggttccccgggtaccncggtaccgtacgtcgacgggccggtaacggcggttccgggtactacggaacgtaaccgtagttactttacccgacttactaccaaccgtacncgtacgcgtaccgcgtagccgtacggaccgtagaagtcgtcgacggttaccgtttaagttttactacggtcggttacgtaacggtccgtaagttttataaacggttacttcccggttacgtaccggtaacggtttcccgggttaccgggggaaccggtacccggtaaggtaccgttaacggagtaccctaacgggaacgttcggtaggtcccgtacgtaacccggtccctaacgtttacttccggttaacccgtttccttacgttaccccgttcccg

SEQ ID NO: 4651 - DNA, 664 bp, Homo sapiens
  misc_feature: GYAE6OF02G58DQ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacagtccagccagtagttcgttttacacgacggtaccaaacaaataagtaacttacttcgtcttacggtaccagaccagaaaaccaggacacgcctacctaagttcgctactattacgtcgggactacgtccgaccgggtcggtcccgggtcctcgaccgtacgttcgaggccggcgacggcggtcagcgactagtactttcactctacaccatcgacgacctacgtcgtacgcgagtacgtagaacgtgtaggtacgtacgttacgtttacttacgttgtacgtagtcgtaagttattaacgttagttaccgttcgtacgttacggttaccgggtttacggggacccgggttaacggtaacgtcgggtagtacgtaccgtaacgtaaccggtacggtacggttaccggtcgtacccggttactacgttcgttcggttacctttacgtacccgtttcccgtaccccg

SEQ ID NO: 4652 - DNA, 641 bp, Homo sapiens
  misc_feature: GYAE6OF02HPJGR.39.31.C09.1.454.CMB.1.raw
  modified_base (246)..(246): a, c, t, g, unknown or other
  misc_feature (246)..(246): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagagggccacatcaactgcaagtccagccagtagttgtttacacaggtaccaacaataagaattacttcgnttaggtaccagcaagaaaccaggacagcctaccgtaagttcgctactactttacgtcgggcagttccgtacccggggaggttcccggggtccctaggacccgtgttcgaggccggctaggcgggtctggaacgactagtactttcaacctcgtcaaccgtatacgagccaacgccttagcgacggtactacggaaagtacgtaggtagggtactaagttttacttaacgtgtaccaggtactaaggtttattaaggttacggtaccgttacctacgtaaggtttaccggtttacggggaccggggtaacctaaggccgtaggaagtacttaacgaacgtaacgtggtacgacgttcgacctactacgttcgtacgtttcctacgtccgttacccg

SEQ ID NO: 4653 - DNA, 647 bp, Homo sapiens
  misc_feature: GYAE6OF02I6XL3.39.31.C09.1.454.CMB.1.raw
  modified_base (464)..(464): a, c, t, g, unknown or other
  misc_feature (464)..(464): n is a, c, g, or t
  modified_base (488)..(488): a, c, t, g, unknown or other
  misc_feature (488)..(488): n is a, c, g, or t
tcagtcgcactagtcacgaccggtgctcgattttagacgtctcatcaaggaaggaaggggcagcaagagtcggtgttgcagacccaggtcttcatttctctgttgctctggatctctggtgcctacggggacatcgtgactgacccagtctccagactccgtggctgtgtcctctgggcgagacgggccaccatccaactgacaacgtccagcccgagagttcgttttaacacacggtaccaacaataacgaattactcgcttagtaccagcaagaaaccaggacagcctactaagttcgctctaatttacgtgggactagttccgtacccgggacgtccggggtaccctgacccgtattccgaggccggcgacggccgggtactggaacgacctagtacttttacgaccttcctaccaaccagtcccaagtcccaacgtcccgtgccgacggcctacggaagngtggcggtactacgtttacttacngttaccgagtacctagttattacgtagttaccgtacctacgtagttaccgttttccggggaccgggtaccaacggtcgtagtacgtacgtaaccgaaacggtacgtggtacggtcctacgaccctacgtacttccgtacggtccttacgccttaccccg

SEQ ID NO: 4654 - DNA, 620 bp, Homo sapiens
  misc_feature: GYAE6OF02HX58T.39.31.C09.1.454.CMB.1.raw
  modified_base (220)..(220): a, c, t, g, unknown or other
  misc_feature (220)..(220): n is a, c, g, or t
  modified_base (303)..(303): a, c, t, g, unknown or other
  misc_feature (303)..(303): n is a, c, g, or t
  modified_base (591)..(591): a, c, t, g, unknown or other
  misc_feature (591)..(591): n is a, c, g, or t
  modified_base (598)..(598): a, c, t, g, unknown or other
  misc_feature (598)..(598): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagtgttttacanaggccaaacaataagaacttacttcgcttggtaccagacaagaaaccaggaacagcctacctaaggttcgacctcatttacgngggactagtccgtacccggggagttcccggggtccctcggaccgatttcaggtccggacgagtccggggtactgaagacagtatttcactctacacctatcagcacgtcctagccaggcctaggaacgagtggtacggctaaggttttacttacgtgtacgagtcgtaagttattaataggtattaccctacgtaacggtttaccgtttcggggacccggggtaaccgaaacgtcggttagggaagtactaacgaaacggtaacgtggttacggaccgttgaccaacncgttcgngtttaccttactacgttccccg

SEQ ID NO: 4655 - DNA, 776 bp, Homo sapiens
  misc_feature: GYAE6OF02IRY69.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtcctccagacctcctggctgtcgtctcgtagggcgagacggccaccgatcaactgactaagtccagccaggtagtacgtttacaccgacggtaccaaacgaaataagtaacttacgttacgcgttacggtaccagtacaaacgaaaccgaggactacgaccttaccgttaagtcgtctacgtagttaccgtgggactaacgtaccgtacccgggaggtcccgggtccgtacggtaccgtacgttcgacggaccggtcgaacggtccggtagtacgacggtacaacgttactttcgaccttcgtacaacccgtatacgtacgaccgtacgtaccgtgaccgtaacggtccgttaaggaaacggtacgttgggtaaccgggttaccttaaagttttacgtaacgtacggttaccgtaacgacgttaacgtttaactaggttaacgtacccgtcggttacctaacgggttttaaccgtttccgggggaaacccgggtactaaacgggtccgttaacggggtaaactaccgtaaaccgttaaacgggtaaccttgggttaaaccgtccgttaaccgtacccgttaacgtacggtttaccgttaccgtttaccgtttaccgacggttttaacccccg

SEQ ID NO: 4656 - DNA, 595 bp, Homo sapiens
  misc_feature: GYAE6OF02FZ4T9.39.31.C09.1.454.CMB.1.raw
  modified_base (301)..(301): a, c, t, g, unknown or other
  misc_feature (301)..(301): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagtgtttacacgaggtaccaacaataagaattacttcgcttggtaccagacaagaaaccaggacacgcctactaagttcgctctatttacgngggcactccgtacccggggtacggtcccggggtcctcggaccgtacttcgacgcggcaggcgggttcagacgacagtactttcactctacaccatcagacacgcctagcaggctaggaatgtggtgtacttagtttacttcgtgtcaagtctaagttactttagtaggttctaccttgtacgttacggtttcggggacggggaaccagtacgtaggactagtaaccgtaaacggtgtcggtacgtaccgcgaccttaccgattccgtacggttacctttaccacgtttcccccg

SEQ ID NO: 4657 - DNA, 1034 bp, Homo sapiens
  misc_feature: GYAE6OF02IC3S8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgcaacgtccagccagtagttgttttaaccacgtacggtaccaaactaaactaaagtaacttacttcgacgtttacggtaccagacaaacgaaaaccaagggaacacgtccctaccgttaaggttcaccttacttaattttaccgtcggggactaacgttacccgggtaaccccggggtacggttccccgggggtccctacggtaacccgtacgtttaccgaacgggtccgggtaccgaacgggtccggggtaccgtacggaacgtaaaccggtacgttaaccgttttaccctaaccgttacccttaacccgtaaacccgtaacttacccggaacggtacccgtaccggttaccccggttaggaacccggggtacgggttacccggtaaagggtaaaacggttaccggtttaagggggttaccgggttaaccgtttttaaacgggtttttttacgttaacccggtttacggttaaccggttaaacgggttaacccggttttaaaaggtttttaaaccgtttttaaacgggtttaaccgggttttaaacccggtttaaccccgtttacggtttaaaacccgggggttttttacccgggggtttttaacccgggggggaaaacccccggggggtttaaacctaaaccgggggtaccgggtttaaacggggaaaccgtttaacccggttaaaaaccccgggttaaaaacccgggtcgggtttaaccggggtacccggggtttaaccgtaacccggttaaccccgttaaccgtttacccggttttacccggttacccggtttttaaccgtttaaccccgtttccccggttttaacccccccgg

SEQ ID NO: 4658 - DNA, 741 bp, Homo sapiens
  misc_feature: GYAE6OF02IE7X3.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctctgggcgagagggccaccatccaactgcaagtccagccagagttcgtttacacgacggtaccaaacaaataagaattacgttcgcgttacggtaccagacaaacgaaacccagggacacgaccccttacttaaaggttgacctacttaacttttaccgtaggggtacctaacgtacccggtaaccccggggtaggttaccccgggggtcccctacggaacccgttagttccgaacgtccggggacctaacgggtccgggggttactacggaagtacgaacggttacttttcccgaacttccctaccaaccctagtccgaagcctaccgcctacggacgtacggctaaggaacgtagtgtacggtacgttaagtttttactacgttcgtacgataccgtaagttatttaacgtaggttacgtacccgttacgtaacggtttccggttttacggggacccgggtaactacggtacgggtaggaacgtaagtaaccgtaaacggttacgtacggtacgggtacctacgacccgtaactacgttaccttccggtacctttacccgtctttaccccg

SEQ ID NO: 4659 - DNA, 730 bp, Homo sapiens
  misc_feature: GYAE6OF02JTHHA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgagagggccaccgatcaactgcaacgtccagccagtagttgtttaccactacggtaccaacaaataacgtaacttacttcgcgttacggtaaccagacaaggaaaccgaggacctacgacctaccgtaagttcgctactaatttaccggcggactacggtacccgtacccggggtacggttccccggggtccctacggtaccgtacgttaccgacggtaccggcgtaacggttccggttaccgtaggacgaacgtgttactttcgaccgtctaccaccgtactcgacgaccacgtcctggaccgtaggtacctaagggaaacgtgttacggttaggtaaccttgttttaacttacgtgtacccgagtaccgtaagtttaacgtaacgttacggtaacgttcccctaaggttaccggtttaccgggttaccgggggaacccgggtaactaaacggtcggtaacgggtaagaccgttaacggtaaaacccgtcggttaggccggtacctcggacccgttaactggttccctaggtttacttcccgacgtttacccccg

SEQ ID NO: 4660 - DNA, 813 bp, Homo sapiens
  misc_feature: GYAE6OF02GV45V.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagttgttttacacaggtaccaacaattaagaattacttcgtcgttagtaccagactaagaaaccaggtacagcctaccttaaagttcgctactaattttaacgagggtactaacgttaccgtaacccggggtacgtaccccggggtccctacggaacccggtagttccgaacggtaccggccgtaacggccgggttacgttacggaacggaaccgtacggtattttaccgaccgttaccgtacgaaacccgtaagttccgaacgttccgaacggtcccttacggccgtaaacgggccttaagggaaacgttagtcgggttaacggtaccttaacgggtttttaacttaacccggtttaggaaccctaccgggtaaagttaaacggtttaacgtttaacggttaaacgttaacgggttaccccttaccggtaaacgggtttaacggtttttacccggggggaacccggggttaaaccaaacgggtttaccgaagggtaaccgtaacgttaacctaaaaccgggtaacggttacggttacgggtacgttacgtaccgtaacccgttaagttcccgttaacggtttcctttaactaccgtttacccccgg

SEQ ID NO: 4661 - DNA, 638 bp, Homo sapiens
  misc_feature: GYAE6OF02FRCKM.39.31.C09.1.454.CMB.1.raw
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagacgggccacatcaactgcaagtccagccagtagtgtttacacacggtccaacaataagattactcgcttggtaccagcagaaaccagacagcctctaagttcgctcatttacgnggcacgttccgtaccgggcgtccgggtcctggaccgtatcaggccgacgngcggtntgacgacagtcttacnctctacacctanacgtacgccacgccgtaggacgacggtcctaggaacgtagtcgtagggtaccgttaaggtttaactttacgttacggtaccgtacgacgttagttaagtttagtacgttaccgttccgttacgtaacggttcggttttaccggggaccgggggaacctaggtaccgtaggggtaacgtacgtaaccgtaacggtaacgttaggaccggttcgtaccggtacccgaactacggttaccgtttcggtaccctacgtcttaccccg

SEQ ID NO: 4662 - DNA, 834 bp, Homo sapiens
  misc_feature: GYAE6OF02F2VR0.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagtgtttacacaggtccaaacaataaagaacttaacttcgactttggtaacccagacctaaagaaaaacccgagggaacctacggacccttacgttaaacggttgaccttacgtaacttttaacgtcggggtactaacgtttaccccggtaaccccggggtaggtttacccccggggggttaccctaccgggaaccgttaaccgtttccgaacgggccgggtacgaaccgggtcccggggttacgtacgggaaacggtaccgtaaggttaactttcccgaaccgttcctacggtaacccatttaccggacgtaccgacgtaccccgtacggtaccgacggtacgtacgaaaggtcgtacggtacgggtaccgttaacggttttaacttacgttacggtaacgtagtaccgttaagtttaaccgttttaaggacggttttaacgtacccgttacgtaaccgtttacggtttttaccggggaacccgggggtaaccttaaacgggtcgttaacgggtaagtaccgttaaaccgaaaaccggttaccggtaacgttccggggtaaccgttacgtacccgtaacgttaccggttccgttaggttaccctttactaccccggtttacccg

SEQ ID NO: 4663 - DNA, 838 bp, Homo sapiens
  misc_feature: GYAE6OF02I4I7R.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccacgacctccctggctgtgtcctcgtgggcgaggagggccacctatcaacgtcgactaagccaagccgaggtagttacggtttacacgtacggtaccaaaactaattaaacggtaacttaccgttacggtaccgttacggttaaacccgagtaaccgaaaccggaaaaccgacggaaccgaacggtaccccgttaccgtttaaacggttcgaccttaacgtttaacttttaccggtacggggtactaaccgttaccccggtaacccggggtacggggttcccccggggttaccctacggttaaccgtcgtttaccggacggtaccggggtcgaggggttccggttacgtacggaacgtacgtaggtaacctttacgtaactcctacgtaactaacgtcgacgtcgaacgtcccgtggacgtacggtacgtaacggtaaggccgttaggtacggttacgttaagttttacttacggttgaccgttagtaccttaaggttaaatttacggttaaccgttagtaccgtttaacgtaccgggtttaccgggtttaaccggggaccggggtaaccggtacggtaacggttacgggaagttaaccgtaagtaaaccgggttaacgttacgggtacgttaccggtactacgtacgttacgttcgtaccggtttacgttccgttaacgttcccgg

SEQ ID NO: 4664 - DNA, 558 bp, Homo sapiens
  misc_feature: GYAE6OF02HHUXB.39.31.C09.1.454.CMB.1.raw
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (338)..(338): a, c, t, g, unknown or other
  misc_feature (338)..(338): n is a, c, g, or t
  modified_base (489)..(489): a, c, t, g, unknown or other
  misc_feature (489)..(489): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccnggacagcctctaagtgctctattacnggcatcgacccgggagtcccggggtcctgaccgatcagcgcagcggtcngacgacagtactttcactctacgaacctatcagacacgtcctgaccaggacttagaaagtgtaggttggacttagttttactacgtgtaccgagcgtaagtattactagtacgttcctgtacgttacgtttcgggacccgggtaacacggngttaggagacgtaacgaacgtaagtcggtaggctacgacgacctatccgttagtccgttacacgttccc

SEQ ID NO: 4665 - DNA, 833 bp, Homo sapiens
  misc_feature: GYAE6OF02G6ZMK.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctcacgactcccgtggctgtgtctcgtgggacgaggacgggtccacataccgaactcgacacgtccacgaccagtagttcgtttacaacgtacggttaccaaataacgtaagtaactttacgttacgtcgtttacggtaaccctagacgtaacggaaaaccgacggtaaccgacgtaccccgtttacccgttaaacggttcggtccctaccttaacgttttaaccgggtacggggtaccgtaaccgttcccgggttaaaccccgggggtacgggttccccggggggttccccgtacgggaccgttacggttccgaagggtccgacggtacgggtccgggttacgtcgggaacgtacgtacgtttacgttttccaacccgttccgtaccgtaacccgttcgtaccgtacgtaccgaaccgttccgtacggtcggtacggtacgtaacggtaagggttacggttcgggacgttacgtttaaccggttttactacgttacggttacgaacggtacttacgtttaacttaagggttaccgtaccgttaccgttacgtacggttaccggtttacggggaccggttaacgtacggtacggtacgaccgtacgttaaccgaacggttaacggtcggtacgtaccggtacgtacgttacgtacgtccttcgttaacgtccttacccgttaccccg

SEQ ID NO: 4666 - DNA, 687 bp, Homo sapiens
  misc_feature: GYAE6OF02JNF82.39.31.C09.1.454.CMB.1.raw
  modified_base (168)..(168): a, c, t, g, unknown or other
  misc_feature (168)..(168): n is a, c, g, or t
  modified_base (185)..(185): a, c, t, g, unknown or other
  misc_feature (185)..(185): n is a, c, g, or t
tcagtcgcactagtcacgaccggtgctcgatttagacgtctcatcaaggaaggaaggggcgagcaagatggtgttgcagacccaggtcttcattctctgttgctctggatctctggtgcctacgggacgatcgtgatgaccagtctccagactccctggctgtgtctntggcgagagggccaccntcaactgcaagtccagccagagtgttttacactaggtaccaacgaaataagaatttaacttcgtccttggtaccagacaagaaacccgagacacgacctacctaagttagcgtactatttacgtaggctaactcctaacccgggtaggtcccgggtccctcggaaccgattcacggtcgacgaggcgggtactcggaagacgatacgtttcaccgtctacgaccagtccacgtacacgtccgttacgccgtagggtcctaaggggaatagttaccggtggtaacccgttaagttttacttacgttagtttacctggccgtaagtttaattaacggttaacggtcttaccgtacgtaagtttccgggtttacgggtccggggaaaccccttagggtaccttacggggaaacttccgtaacggaaacgttaaccgttaggttcggggaccctacggtaccgacccgtagttcctaccgggtttatcccttaccgttaaccccgg

SEQ ID NO: 4667 - DNA, 790 bp, Homo sapiens
  misc_feature: GYAE6OF02JL5FW.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctggctgtgtctcgtgggcgagacgggccaccatcaactgacaacgtccacgccagagttgtttacacacggtaccaacaataagaactttaccttcgcttacggaccaagaccaaacgaaaccaggaaccacgccccttaccgtaaggttcgtcctactaagtttacgtcggcgtactaccgtaaccccggggacggttaccccggggtcccgtcgaaccgtagttccacggcggacggaccgggtccgggtacgtagaacgtaacgtacggttactttacccgaccttcctaccgaaccctaactcgaacccgaccgtacgtccgtcgggtacgaaccgggtaccgtaaggaaagggtacgttccgggtttaggtaaccgtttaaggtttacgtttaacgttaccggtttaacgacgttaacgttaacggttaatttaacgttacgttaccggttacccgttaccgtacgggtttaccgggttttccggggaaccccggggttaacgtacggtacggtagggtaaccgttaccgtaaccggtaaaaccgttcggttacggttacgacgttaccgacccgtacccttacggttaccgtttcggttaccccttacttacccgtttaccccgg

SEQ ID NO: 4668 - DNA, 626 bp, Homo sapiens
  misc_feature: GYAE6OF02G68ST.39.31.C09.1.454.CMB.1.raw
  modified_base (211)..(211): a, c, t, g, unknown or other
  misc_feature (211)..(211): n is a, c, g, or t
  modified_base (296)..(296): a, c, t, g, unknown or other
  misc_feature (296)..(296): n is a, c, g, or t
  modified_base (337)..(337): a, c, t, g, unknown or other
  misc_feature (337)..(337): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtntttacacaggtccaacaataagaattacttcgcttggaccagcagaaaccaggacagacctcctaagttgcctactattttacgngggactagtccgtacccgggagttcccggggtcctgaccgnttcgaggtcggcaggtcgggtctgagacaggatttccgactcgtcaacactcagcagcctcgcaggctgaagtatgtcggtattaacgtttacttacgttcgtacgtagtacgtaagttaatttagttacgttacttccgttacgtacggttaccggttttacgggcccgggggtaaccctaacgggtaccgttagggaacgtactaaccggaaacggtacgttacggttacggtcctacggtaccgaaccgttcgttaccgttcgttacccgttacgtacttaccccg

SEQ ID NO: 4669 - DNA, 764 bp, Homo sapiens
  misc_feature: GYAE6OF02H93UR.39.31.C09.1.454.CMB.1.raw
  modified_base (131)..(131): a, c, t, g, unknown or other
  misc_feature (131)..(131): n is a, c, g, or t
  modified_base (487)..(487): a, c, t, g, unknown or other
  misc_feature (487)..(487): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacgggganagtcgtgacgtcgaaccctagtcctccacgacctcccgtggctgtcgttcctcgtgggcgaggacgggccaccataccaacgtcgactaaccggtccacggccaagtagttacgtttaacacgtacggtaaccaaacaaacgttaaagtaacgttaacgttccgtacgttaccggtaaccgagtacgaaccgaaaccgtagggaccacgtacctacgttaagtcgacttacgtatttaccgacggactacgtaccggtaccgggtacgtcccgggcctagtaaccgagttcgaccggtcggacgcgggtcggactgggtaacagtacgttacgtactacgtccgtacctaactacncgagctacgcctagacgacgtacgtagaacggtacgtggtaccgtagttacgttttagttacccgtagtacgacgtacttaagtcttaacggttcgttaaccggtaccgtacgacggttttaccgggtacgggtaacccggggaaccgtaaacgtcggtaacggtaaggtaaccctaaaccggtaaccgggttaaactccgggtagttacccggtaccgtacctacggtacctttaccggttacggtttacccgttacccgaccgtttaccccccgg

SEQ ID NO: 4670 - DNA, 803 bp, Homo sapiens
  misc_feature: GYAE6OF02GBVZG.39.31.C09.1.454.CMB.1.raw
  modified_base (538)..(538): a, c, t, g, unknown or other
  misc_feature (538)..(538): n is a, c, g, or t
tcagtcgcactagtcacgaccggtgctcgatttagacgtctcatcaaggaaggaagggcagcaagatggtgttgcagacccaggtcttcatttcctctgttgctcgtggactctctggtgcctacgggacagtcgtgatggacccagtcctccagtacctcccgtggctgtgtctacgtgggcagagggccaccgatcaacgtgacaacgtccacggccaggtacgttacgtttaaccacgacggttaccaaacgtaaagttaacgtaactttaccgtttacgccgtttacggaaccacggaacaacggtaaaaccgcgggaacctaccgtcccgttacctttaaaggttccgtaccgttaacgtttaaacgttttccggtacgggaccttaacggtaaccccggttaccccgggggtaaggtttccccccggggttaccctaggggtacccttagttaccgacgggtccggacgtaccggttcggggtacgtcgaacgtacgacgtttactttccgacgtctaccaacgttacgcgngaccacgttcgtacgacgtacggtacgtaacggatgttaacggtcgttaccgtttaatttacgttacgtacgtacgtacgtctaagtactttaacgtacgttacctacttaccggttaacgttacgggtttacccgggaacggttactaacggtcggtaacgtacgtaacgtaaccggttaaccggtacttacgggcggtaacctcccggttaacctacggttccttacggtttccggttaccctttacgtaccccgtttacccg

SEQ ID NO: 4671 - DNA, 587 bp, Homo sapiens
  misc_feature: GYAE6OF02F9MQG.39.31.C09.1.454.CMB.1.raw
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (370)..(370): a, c, t, g, unknown or other
  misc_feature (370)..(370): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttaacacaggtccaacaataagaattacttcgcttggtaccagcagaaaccaggacacgcctcctaagttgctcatttacngggcactctacccgggngtccgggtcctgaccgnttcagcgcaggcggtctgacgacagactttcacctctcaaccntacagcacgcctgctaggcaggtaatagtggtagtctaaggtttattacagttnacgtnacttagttacttaggttactctactacggtttacgtttaccggggaccgggtaaccgtaggtacgtacgggaacgtacgtaacctaaaacgggtaacttacggacggttacgtcggtaacctacctattccgtagtttacgttacctagtttcccccg

SEQ ID NO: 4672 - DNA, 635 bp, Homo sapiens
  misc_feature: GYAE6OF02GS58B.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtcctccagactccctggctgtgtctcgtgggcgaggagggccacatcaactgcaagtccagccagtagttcgtttacacgaggtaccaaacaaataaagtaacttacttcgtcttaggtaccagccaagaaaccgaggacacgcctacctaagttcgctctatttacgtcgggcactccgtacccggggtacggtcccggggtccctcggaccgtagttcacggcggcaggcggtactggagacgtagactttcactcctactaacctagtcaacgccacgtccgtagcctaggcctaggaagtagtggtcggacgttagttttacgttacgttcgtacacgtactagttaatttaagtacgttactccgttacgtagttacggtttcggggacccggggtacaggtcgtaggacgtataaccgaaagttccgtggtacgggtctcggtacctaacgtagtttccacgtttccttaccgtacttacccccg

SEQ ID NO: 4673 - DNA, 644 bp, Homo sapiens
  misc_feature: GYAE6OF02GZ11E.39.31.C09.1.454.CMB.1.raw
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
  modified_base (384)..(384): a, c, t, g, unknown or other
  misc_feature (384)..(384): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacacggtccaacaataagtaattaccttcgcttggtaaccagcaagaaaccaggaccagccctacctaagttgctctatttacngggcatccgtacccgggagtcccggggtcctgaccgtattcgagtcgcaggcggtntgagacagtactttcactctacactntcagcagcctgcgaggctaggaagtatggtacggtacttagttttacgttacgttgtaccgtagtactaagttatttaagttacgttacgttccttacgtacgtttaccggttttacggggaccggggtaaccaggtaccgttagggaacgtacgtaacccgtaaaccggtaacgttacgggttacgggtaccgttacggaacccttaccgttacgttacccggtttacggtttaccctttccgaccgttttacccccgg

SEQ ID NO: 4674 - DNA, 647 bp, Homo sapiens
  misc_feature: GYAE6OF02FYX8D.39.31.C09.1.454.CMB.1.raw
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggcccaccatcaactgacgaagtccagccagagttgtttacacaggtaccaaacaataagtaattaccttcgcttggtacccagcaagaaacccaggacagtcctacctaagttcgctntaatttaccgnggggactagtaccgttacccggggagtcccgggggtccctaggaacccgtattccaggccggacaggccgggttctgaggacagactttcgactgtccacatcacgcacgccgtgacacggctaggaacgagtcggtgacgtagttacgtttaagtcgtactacgactaaacgttaatttaagtaagttaccgttacctacgtacgttacgttttcgggacccggggtaaccaaggttccgttaggagtacgtaacgaacggtaacgttaggtacgggtacgtacgtaaccgaccgtaacgttccgttaccgtttacctttccgtacctttaccccg

SEQ ID NO: 4675 - DNA, 570 bp, Homo sapiens
  misc_feature: GYAE6OF02F6CFV.39.31.C09.1.454.CMB.1.raw
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (417)..(417): a, c, t, g, unknown or other
  misc_feature (417)..(417): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttacacaggtccaacaataagaattacttcgcttggtaccagcagaaaccaggacagcctcctaagttgcctntatttacngggcattccgtacccgggaggtcccggggtccctgaccgtattcgagcggcaggtcggtctgagacagtactttcactctcaccatcacgcaggcctggcgacggctagaagtagtgtacggtnttagtttattcgttagtcagtcgtaagttatttagttaagttaccgttaccttcgtaagttaccggtttttacggggaccgggtaaccaggtcgtaggagactacgaacgtaacgttggtcggctagacacctctctcgtcttctacttcccg

SEQ ID NO: 4676 - DNA, 629 bp, Homo sapiens
  misc_feature: GYAE6OF02H1HZ8.39.31.C09.1.454.CMB.1.raw
  modified_base (255)..(255): a, c, t, g, unknown or other
  misc_feature (255)..(255): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttacacaggtaccaaacaataagaattactcgcttggtaccanacagaaccagacagcctacctaagtgtactctatttacgtggactagtccgtacccgggagttacccgggtcccctagtaccgtacttcaggccgtacacggtcgggtctagacgacagtactttacactccgtacacctactacagcaacgccgtagcgacgtacgtagaaacgtagtggtacgtacgtagttttacttacgtacgtcagtaccgtaagttagtaacgttagttacgttacctacgtaagttaccggttttacgggacccggggtaacctaaggtgtacggaagtacgtaacgaacgtaacgttacggtcggactacggaccgtaccgtacgttaccgttcgttaccttactactttaccccg

SEQ ID NO: 4677 - DNA, 658 bp, Homo sapiens
  misc_feature: GYAE6OF02H2XBY.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctcccctggctgtgtctcgtgggcgagagggccaccatcaactgcaagtccagccagagttgttttacacgacggtccaaacaaataagtaattacttccgtcttacggtaccacgcaagaaaccaggacacgcctacctaagttgctctatttacgtgggcagtccgtacccggggcggtcccggggtccctcggaccgtattccgaggccggcgacggtcggtctggacgacagtactttcacttccgtaccaccactcacgccacgtccgtgaccgtaggcgtaaggaagtgttgtagcttagttttattaacgtggtacgagtacgtaagttactttaagtacgttacgtaccgttacgtacggtttccggtttacgggggacccgggaactaacggtcggtagggaactacgtaaccgtaaacgtacgttaggtcggtaccgtacggtaccctacgttaccgttccgttacggtttaccctttagacccgttttaccccg

SEQ ID NO: 4678 - DNA, 817 bp, Homo sapiens
  misc_feature: GYAE6OF02H5404.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgaccagtctccagactcccgtggctgtgtctgtggcgaggacggccacatcaactgacaacgtccagccagagttctttacacgacgtaccaaacaaataagtaacttacttcgcgttacggtaccaaggactaacggaaaccaggtaaccacgcccgttactaaaggttctaccgttattaacgtttccgaggtactacgttacccggtaacccggggttacggttccccgggtacctacggtaacccgtagttaccgacggtccggacgacggttccggggttacacgggtaacgacgtaggtttactttaccaaccgtttacctaccgacttacgtcgaacgcgtaccgtccgtacgaccgtacgggtaccgtaagaaacggttcggttacggtacgttaaccggtttaagtttttacgttaaccgttaggttactaacggttacgtttaacgttaacttaacgtttacggtttaccgttaccgttccggtttaacggtttaccggggttttaccggggaaacccgggttaacggtaaacggttcgtaccggggttaacgtaacgttaacccgggtaaaacggttcggttacggttcggaacccgtttacgaacccgttaccgttaccggttaccgtttaccgtttaccgtttaccgtttaccccgtttaccccgg

SEQ ID NO: 4679 - DNA, 635 bp, Homo sapiens
  misc_feature: GYAE6OF02GRD3U.39.31.C09.1.454.CMB.1.raw
  modified_base (395)..(395): a, c, t, g, unknown or other
  misc_feature (395)..(395): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacgaataaagaattacttccgtcttaggtaccagcaagaaaccaggacacgcctacctaagtgctctattactgggctatccgtaccgggaggtcccgggtcctcgacctattcgacgtcgcgacggcggtctgacgacacgtaatttcactctacacactcgacncacgcctgacgagcgtagaagtgtacggtggacttaggtttacttacgtacgtacgtacgacttaagttagtttaacgtacgttacgttacccttagttaacggtttaccggttttacgggggaacccgggtaaccgtacggtacggtacggaacgttactaacggaaaaccggtcgttagggtacggtaccgtacgacctaccggtattccgttatttccgttacctacgtttcccccg

SEQ ID NO: 4680 - DNA, 624 bp, Homo sapiens
  misc_feature: GYAE6OF02F7K8X.39.31.C09.1.454.CMB.1.raw
  modified_base (295)..(295): a, c, t, g, unknown or other
  misc_feature (295)..(295): n is a, c, g, or t
  modified_base (345)..(345): a, c, t, g, unknown or other
  misc_feature (345)..(345): n is a, c, g, or t
  modified_base (381)..(381): a, c, t, g, unknown or other
  misc_feature (381)..(381): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaacaataaagaattacttcgcttggtaccagcagaaaccaggacagcctcctaagttgctcatttacgngggcatccgtacccgggaggtcccggggtcctgaccgattcacggcggcnggcgggtctggacgacagtatttcactctcacctancagcacgcctgacgaggcgtagaagtgtggtggtacttagttttacttaacgttcgtctagtacgtaagttaacttagttaacgttacgttccctacgtaacggtttacggttttaccgggggaccgggggtaaacctaaggtccgtagggtaacggtacttaaccggaaaaccggtaacgttggttacgggcgttacgacctaaccgtagttcccttgttcctttacgtaccgtttaccccg

SEQ ID NO: 4681 - DNA, 636 bp, Homo sapiens
  misc_feature: GYAE6OF02JF116.39.31.C09.1.454.CMB.1.raw
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggcaccatcaactgcaagtccagccagagtgttttacacaggtccaacataagatacttcgcttggtaccagcagaaaccnggacagcctcctaagttnactctattactggcatccgtacccgggacgtccggggtccctgaccgtacttcgacgcggtcaggtccgggtctagacgacgagtacttttccgaacgtctcaaccgacttcgaacgccacgtcctacgcgacggtacgtaggaaacgtaagttgtacggtccgtaagttttacgttaaccttggtaccgagttactaggttaacttagttacgtacgttacctcgtaacgttacggttttcgggaccggggtacctaacggccgttagggaacgtacgttaaccgaacggtaacgttggtaaccggtcgtacgtacccgtaccgtacttccgtacgttaccgttactccgttaccccg

SEQ ID NO: 4682 - DNA, 706 bp, Homo sapiens
  misc_feature: GYAE6OF02F1KKC.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctcgtgggcgaggacggccaccatcaacgtgacaacgtccagaccaggtacgttgtttacacgacggtaccaaacaaataagtaattaccgttcgtcgttcggtaccagacgaagaaaccgaggaacacgacccttaccgttaagttcgaccttacgtatttacgtacgggactacgttcccggtaacccggggtacggtcccgggtccctcgaccgtattccgacggtcggacgacggtccgggtctggaacgtacgtagttactttccgacgttactaccaaccgtactacgaagtccacgtaccgtcgacgtacggacgttaggaacgtgttaggtacggtacttaagtttacgttacgttacgtacgtacgtacttaagttatttaacgtacgttaccgttaccgtacgtacggtttaacgggtttaccggggaccggggtaacctacggtcgtaacggtactacgtaacgtaacggtacgtggtacggcgtacgaccgtacttacgttcgtcgttaccttacgtaccttccccg

SEQ ID NO: 4683 - DNA, 758 bp, Homo sapiens
  misc_feature: GYAE6OF02IE3OS.39.31.C09.1.454.CMB.1.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtctccacgtacctcccgtggctgttgtcgtcgtgggcgaggcgggaccaccataccaactgacagtccacgaccagagtttgtttaacagtacgacaaactaaataacgttaacttacgtcgtagtttacgacctagacaacgaaacncggacacgtaccctactaagttgctacttacgtttacgcgggtactaaccggttaccggtaacccgggtacggtttccccgggtccccgtacgtaccggtaccgttacggacggaccggcggtacgggccggggttacgtacgaacgaccgttagttaacctttacgtacctaccgttaccaaaccgtaactacaacggtccgaccggtacccttgggaccgtaacggtagtaacggaaacggttgttacggtacggttagtttacggttttaaacttccgtgtaacgagtaaccgttaaggtttagtaagtttacctaccggtacgttaccgtaaggtttccgggttaccggggaaccgggtaactaggttccggaaggttaacaccgttaaccgggtaactaccggttgtacgtacgaacgccctaagtaccttcgttacgttaaccctccttagttaccccg

SEQ ID NO: 4684 - DNA, 645 bp, Homo sapiens
  misc_feature: GYAE6OF02FHQG2.39.31.C09.1.454.CMB.1.raw
  modified_base (229)..(229): a, c, t, g, unknown or other
  misc_feature (229)..(229): n is a, c, g, or t
  modified_base (396)..(396): a, c, t, g, unknown or other
  misc_feature (396)..(396): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagtgtttacacaggtaccaanaattaagaatttacttcgacttggtaccagcaagaaaccaggacagcctacctaagttgctctatttacgtgggcagtccgtacccgggtacgtccggggttccctgaccgtattcgacggcggacaggacggtctaggagacgagtactttcgactctcaaccgtntacagacgacgtaccgtgcgtacggtgtaggaaagtagttgtacgggtacgttacggtttaattacgttagtccgtagacttacgttaatttaacgttacgttaacgttccctagtaacggtttacgttttaccgggggtacccgggaacctaaacggtgtacggtaacgtacgttaaccgaacggtaaacgttggttacgtacgtaccgactaaccgtacttacgtcgtttcttacctagttaccccg

SEQ ID NO: 4685 - DNA, 724 bp, Homo sapiens
  misc_feature: GYAE6OF02IDCU9.39.31.C09.1.454.CMB.1.raw
  modified_base (370)..(370): a, c, t, g, unknown or other
  misc_feature (370)..(370): n is a, c, g, or t
  modified_base (449)..(449): a, c, t, g, unknown or other
  misc_feature (449)..(449): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcggtgatcgacccagtcctccagacctcccgtggctgtgtctcgtagggcgaggacgggccacagtccaacgtgactaacggtccacgaccaggtagtttacgttttaaccgaacgtaacgtaccaaaactaaagtaagtaacttttacgtccgtactttcgggtaccaagaccgaaacgaaaccgaggaccacgtaccccgttacgttaagtttcgaccttaacttaacgtttacggnggtactaccgtaccggtacccggggacggttccccgggtccgtacgaccgtatacgcggtaccgggctacgggccggtntagacgactagtacctttaccgtactcctccgtaccagttacgaccgacgtcgtccgtgaccgtaacggcgttagaaggttgtcggtgacgtttatttacttgtacgtagagtcttaagttatacgttaacgtacctacttacgttcggtttacggtttcccgggaaccggggtatacgcggtaagtaccgacggtaactaaaccggtcgttaccggaggtccttacgaccgttaacctacggttcttaccggttcttacccgccgtttaacccc

SEQ ID NO: 4686 - DNA, 754 bp, Homo sapiens
  misc_feature: GYAE6OF02H1NCF.39.31.C09.1.454.CMB.1.raw
  modified_base (513)..(513): a, c, t, g, unknown or other
  misc_feature (513)..(513): n is a, c, g, or t
  modified_base (714)..(714): a, c, t, g, unknown or other
  misc_feature (714)..(714): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgccgtacggggacatcgtgataccgacctactcctaccacgtacctccgcgtcgtgtctcgtcggtggacgaggacggccacatactacgacgaacacggtaccacgacctaagtacggttttacgttaacacgtacggtaacaaaacaaagtaacgttaacttacgtcgttacgtaccgtacacgacgaaaccgaaacgacggacaccgtccgttaaacttaggttcacttaagttaccgttacggtacgacgtacgtaccggaacccggggttaccggttccccggtacgtacgtaaccgtacgtacacgggcggaacgccggggttataccggagtaaacggtacgatttacgttacacctacctaccaattaccgacgacgtacggtaccngtacgacgacgtaccggttaagaagttagtacgtacggtacgtttacgtttacgtacgtactacgaagttacgtaagtttaagtaacgttagttaccggtactaacggtacggttaccgggtacccgggttaacgggggtaaccaaggttacgggaacgaggtacctaacggtaaacgtgttacgggctccggtaaccacnccttacgttacgttacgtaccttaccttacttacccccgg

SEQ ID NO: 4687 - DNA, 676 bp, Homo sapiens
  misc_feature: GYAE6OF02HI8V5.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaataagtaattacttcgtcttggtaccagcaacgaaaccaggacacgtccctactaagttgctactatttacgtgggacacgtccgtacccggggacggtcccggggtccctgaccgtattcgacgcggcgacggtcgggtctggagactagtactttccacttcctacacctatcacgccacgtcctagacgcggtctaggaacgtagttggttaggtttaagttttacgttacgttgttacgagtcttaagttatttacgttacgttacgttccgtacgtaggttaccggttttccgggggacccgggtaaccgtacggtcggtagggaacgttaacgtaccgtaaacggttaacggttcgggttacggtaccgttaccggaccctaaccgttacgttccgttaccgtttcccgttaccgttaccgttccccctttaccccgg

SEQ ID NO: 4688 - DNA, 629 bp, Homo sapiens
  misc_feature: GYAE6OF02GYRAZ.39.31.C09.1.454.CMB.1.raw
  modified_base (302)..(302): a, c, t, g, unknown or other
  misc_feature (302)..(302): n is a, c, g, or t
  modified_base (593)..(593): a, c, t, g, unknown or other
  misc_feature (593)..(593): n is a, c, g, or t
  modified_base (610)..(610): a, c, t, g, unknown or other
  misc_feature (610)..(610): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttacacaggtaccaaacaataagaacttacttcgcttggtaccagacaacgaaacaggacacgcctacctaagttgctctatttacgngggcatccgtacccgggaggttcccggggtccctcggaccgtacttcgaggcggcacggcgggtctgacgacgagtactttcacttcctacaccactcacgcacgcctagacgaggctagaaggtgttgggtcggacttaaggttttacttacgttcggtacagtactaacgtttattaacgttaggtacgttaccctgtaacgttcggtttaccgggggccggggtaaccgtaacgtcgttagggactagaccgtaaacggtacgttcggtcggtacttcgaccttaccncgttaccttaccggttntttacccacgtttaccccg

SEQ ID NO: 4689 - DNA, 775 bp, Homo sapiens
  misc_feature: GYAE6OF02HVFNN.39.31.C09.1.454.CMB.1.raw
  modified_base (522)..(522): a, c, t, g, unknown or other
  misc_feature (522)..(522): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacgggacatcgtgatacgacccagtcctccagacctccctggctgtgtctcgtgggcgagacggccacatcaactgacaacgtccagaccgagtagttacgttttaacgacgtacggtaaccaaacgtaaattaaaacgtaactttaccgttccgtacgtttacggtaacccctacgaaccggaaacaaaaaccgtacggtaaccgaccgttacccgttaaccgttaaaggtttccgtaccttaacccgttaagttttaaccggcgggtaactacgttaacccgggtacccggggtaccggttccccggggaccctacggtaccgtaagttccgaacggcgtacggcggtacggtactacggaacgactagttactttcgactacctaccgaacctaanccgtacgaaccgcgtaccggtacgacggtacgtacgaacggtaagtcgttaggtacgtaacgttaagttttaacttacgttcgtaacgagtacgttaaagttaacgttagttaacgttacgttacttacgtacgtttaccggttacggggacccgggtaacgtaacggtcgagggtacgaacgaaccggtaacgtcgttaccggagtccgacgtacgtactaacggttccttactacgttcgtaacctccccg

SEQ ID NO: 4690 - DNA, 686 bp, Homo sapiens
  misc_feature: GYAE6OF02HF80K.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccaagccagagttgttttacacaggtaccaacaataagaattacttcgtacttagtacctagacaagaaaccgtaaggacacggcctaccgtaaagttgctactatttaacgcggacactccgtaacccgggtcgtacccggggtccctagtaccgacgttcaagccggcgtaacggcggtctagaacgtaccgagttacttttacccgaacttcctaactaccaattaccgacgtaccgtaggtaccgttagaccgtaacggtcgttaaggtaaagtagttacggtaggttacgttaacgttttagtttaacgttcggtacgtagtaccgttaagttaactttaagtaagttaccttaccgtacgtagttaacgttttcgggaacccggggtacctaaggcgtaggaacgtactaacgaaacggtacttaggtcggtacgttcgaccgtaaccctacgtaccttcgtacctttacgacgtttccccg

SEQ ID NO: 4691 - DNA, 600 bp, Homo sapiens
  misc_feature: GYAE6OF02HHX8W.39.31.C09.1.454.CMB.1.raw
  modified_base (304)..(304): a, c, t, g, unknown or other
  misc_feature (304)..(304): n is a, c, g, or t
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttaacacgacgtaccaaacaataagaattactcgcttaggtaccagacaagaaaccaggacacgacctactaagttgctactatttacgnggactagtccgtaaccgggtggtcccggggtccctaggaccgtatcgagcggcagtcgttcagagacagtattcactctacacatcagcncgctgacagtacagaacgtntggtcgtacgtagtttatacgttgtactagtactagttattacgtaacgttcgtacccttagtacggttacgtttaccgggggacccgggtaacgagtacgtagggtactactaaccgaaacgtacggttcggtacgtcgtacggacctaccgttatcgtttacgtcctttacgccgtttaccccg

SEQ ID NO: 4692 - DNA, 628 bp, Homo sapiens
  misc_feature: GYAE6OF02GD3EG.39.31.C09.1.454.CMB.1.raw
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
  modified_base (387)..(387): a, c, t, g, unknown or other
  misc_feature (387)..(387): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (461)..(461): a, c, t, g, unknown or other
  misc_feature (461)..(461): n is a, c, g, or t
tcagtcgcactagtcacgaccggtgctcgatttagacgtctcatcaaggaaggaaggggcagcaagatggtgttgcagacccaggtcttcatttctctgttgctctggatcttctggtgccgtacggggacatcgtgatcgacccagtcctccagacctcccgtggctgtgtctcgtgggcgaggacgggccaccatccaactgcaagtccctgccagtagttcgtttaacacgtacggtaccaaactaataaagtaactttacttcgtcttggtaaccagacaacgaaaccgaggacncgcctacgtagtcgctactatttacgnggctactaccgtacccgggcggtcccgggtcctagaccgtactcgagcggcgaggcggtcngagactagtacttcaccttcactaacncacgacnccgacgtccagacgaggtcgtaagaagtcgtggtacggtnttaacgtttaacttcgtcgtacgtgtaaccgttattagttaattacgttcgtacctcgtaacggtttcggtttccgggaaccgggtaacccaggtccgtaggaccgtagtaaccgtaacggtgtacggtgacgtaccgctaacgtcttcgtctaccttctactcccg

SEQ ID NO: 4693 - DNA, 619 bp, Homo sapiens
  misc_feature: GYAE6OF02FNTMB.39.31.C09.1.454.CMB.1.raw
  modified_base (238)..(238): a, c, t, g, unknown or other
  misc_feature (238)..(238): n is a, c, g, or t
  modified_base (391)..(391): a, c, t, g, unknown or other
  misc_feature (391)..(391): n is a, c, g, or t
  modified_base (436)..(436): a, c, t, g, unknown or other
  misc_feature (436)..(436): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctccctggctgtgtctcgtgggcgagagggccaccatacaactgcaacgtcagccagtagttgtttacacgaggtaccaaanaataagtattactgacttacggaccagacacgaaacacggacagcctactaggtcactctatttacgcggctacgtccgtaaccgggacggtcccgggtccacggaccgattacgacggcggacgtacggccgggtataggagtaccgaagtntttacccgacttaccgacaactacgtacgaacggtccacgtccgngaccgacggtacgtagaacgtgacgtggtagtacgttttactacgtgtacgagtactagttacttagacgttactacgtacgtacgttacggttacgggaccgggtacagtacggtagacgagaaccgaagtacgtaggtacgacttacgacgtaccgattacctcgttacttcgtaccgtcc

SEQ ID NO: 4694 - DNA, 560 bp, Homo sapiens
  misc_feature: GYAE6OF02G4107.39.31.C09.1.454.CMB.1.raw
  modified_base (118)..(118): a, c, t, g, unknown or other
  misc_feature (118)..(118): n is a, c, g, or t
  modified_base (298)..(298): a, c, t, g, unknown or other
  misc_feature (298)..(298): n is a, c, g, or t
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
tcagtcgcactagtcacgaccggtgctcgatttagacgtctcatcaaggaaggaaggggcagcaagatggtgttgcagacccaggtcttcatttctctgttgctctggatctctggtncctacggggacatcgtgatgacccagtctccagactccctggctgtgtctctgggcgagacgggccaccatcaactgcaagtccagccagagttgtttacacaggtccaacaataagtaattaccttcgcttggtaccagcaagaaaccaggacagcctctaagttgactctatttacgnggctatcgtaccgggnggtcccgggtccngaccgnttcagcggcacggcggtctgagacagtatttacnctctcacctatcagcacgcctgcngcaagagtntgggnattattatctgtacatacgtagttacttatcgttacgtcctagtacgttacggtttcggggaccgggtaacctaggtacgtaggaactagaaccgtaaaacggtgtggtacggtctaccgactacctattccgttcttcttccttacttccccgg

SEQ ID NO: 4695 - DNA, 822 bp, Homo sapiens
  misc_feature: GYAE6OF02IS66Z.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccaggtctccagactccctggcctgtagtctctgggcagacgggccaccatcaactgacaagtccagccagtagtgttttacactacggtaccaaacaataagtaacttacttcgaccttcggtaccagacaacgaaaccgaggtacacgtcctacctaacgttgcctactactttacgtacgggactaatacccgtacccgggtagtcccccgggggttcccttacggaccgtaacgttaccgacgggtacccggtacgaacggtccggggtacgttaccgggacgaaacggttaacttacgttttaccgaacccgtttaccttacccaaaccttaacgttccgaaacggtcccgtaaggttacccgtacggtaccgtaacgggaccgtttaagggaaacgtacgttcgggtacggtaactaacgttttaacgttacgttgtacgttaacgcgttaaagttaagtttaacggttacgttacggttaccccggtacgttaacgggtttaaccgttttacggggggaacccggggttaaaccgaaacggtcgggtttaaccgggaaagttacgtaaaacccggtaaacttaaccgggtcggttaaccgggtacttaaccgtacccgttaacttccggtaaacccgtttcgttaacccggtttacctaacccgttttcccccgg

SEQ ID NO: 4696 - DNA, 676 bp, Homo sapiens
  misc_feature: GYAE6OF02FJV1D.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtccaacaataagaattacttcgtacttggtaccagcaagaaaccaggacagtcctctaattcgctcatttactcggctatccgttacccgggacggttccccggggtcccttacggaccggtacttacgacggccggcgacggcgggtactggaacggacagtaactttccacgtcctaccaaccgattaccgacggccacggtcccttggacgacggtccgtaagaacgtagtcggtcggtacgttagtttaactttaccgttgtcgaacttcgtaagttaaacgttttagtaacgttacgttaccgttacttaaccggtttacggttttaccggggaaccggggtaaccctaaaggtccggtaggtaacgtacgtaacgaaaccggtaactgggtaacggtccgtacgacctaaccgttacgtcttacggttcccttagtaccctttacccg

SEQ ID NO: 4697 - DNA, 685 bp, Homo sapiens
  misc_feature: GYAE6OF02HXIXX.39.31.C09.1.454.CMB.1.raw
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (408)..(408): a, c, t, g, unknown or other
  misc_feature (408)..(408): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactccctggctgtgtctctgggcgagacgggccacatacaactgacaacgtccacgccaaggtagttgttttaacacgacggtaccaaacaaataaagtaattaacttcgtacttggtaccacgacaacgaaaccaggacacgccttacctaaggttcnctactattacgnggctactcgaccggcgtccgggccngaccntcgtcgacgntacggtcggctggagacgagtacttttcgaacttctaccactacnctacgcgtaacgcctgacgtaggtacgtacggaagtacggttaggtacgggtacgttaacgtttttactaccggttacgtttacgaacggtacctaaggtttaacttaacgttacgttaaccggttaccctacggtttaaaccgtttccgggttttaccggggaacccgggggttaaccaaacggtcggtaacgggctaacgtaaccggtaacgttaacgtagggtcgtacgtacgtacgacttcgtaaccgttcgttacctacgttacctaccccg

SEQ ID NO: 4698 - DNA, 723 bp, Homo sapiens
  misc_feature: GYAE6OF02HWH66.39.31.C09.1.454.CMB.1.raw
  modified_base (425)..(425): a, c, t, g, unknown or other
  misc_feature (425)..(425): n is a, c, g, or t
  modified_base (506)..(506): a, c, t, g, unknown or other
  misc_feature (506)..(506): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgaccagtctcagctcctggctgtgtctcgtggcgagaggccacagtacactgacaacgtccagcagtagttacgtttacacacggtaccaaacgtaaattaacaattaccgttcgtacgtttacggtaaccaggacgtaacgaaacccagggaaccagtacccgttacctaagttcgaccttataacgttttacgcggtctaacgtccggtacccgggggcgttcccggggtaccctaggaaccccgttgttacgacggtccggtacggtaacgggtaccggggttnagggtaaacgacggtaagttaccttttacaaccgttccgtaaaccactaccgaaggtctacccggacgtcgtacggtacgnggtaaccagggtaactaggtcgtacggtacgtttaacggtttacttagtacgtacgtacggtacgttaagtcgtttaagtacgttacgttacgtcgttaacgttcggtacgggaccggtagtaccgtaggtagtactataaaccggtaacggttacaacgggttcaccggagtccctaagttccgtacgttcggtttaacttccgtacccgttaccg

SEQ ID NO: 4699 - DNA, 858 bp, Homo sapiens
  misc_feature: GYAE6OF02JLMVG.39.31.C09.1.454.CMB.1.raw
  modified_base (380)..(380): a, c, t, g, unknown or other
  misc_feature (380)..(380): n is a, c, g, or t
tcagtcgcactagtcacgaccggtgctcgatttagacgtctcatcaaggaaggaaggggcagcaagatcggtgttgcagacccaggtcttcatttctcgtgttgctcgtggatctctggtcgccgtacgggactactcgtgagtcgacccagtctccagacctcccgtggcttcgtgtcctcgtggggacgacggacgggcccaaccactaccaacgtcgacctaacggtccaacggcctaaggtacgttcgttttaaccacgacggtaccaaactaagtaaacgttaacttaccgttcgtcgttacggtaccacgactaacggaaaccgaggtaacaccggtacctaccgttaaagttcgccttacttaatttaccggnggaccttacgttcccggtaaccgggtccgggttaccccggggtaccctacggtaacccgtacgttaccggacgggtaccggtaaccggtaacggtccggggtaccgttaggtaacccggtaaaccggttacggttaacctttttaccgaaccggttcccgttaaaccctaaccgttaaccgttacggaacccggaccgttaacccggtccggttacgaacggttaccggtacggtaccggtaaaggttcgtaacgggttacggtaccttaacggtttttaccgtacgttaacgtaccgtaagttccgaagtttaaaccgtgttaacccgtaccggtacctaccgggtaaccgttttaaccgggttacgggaaccccggtaataccggacggttaacacgggtactaacgggtaacgtcggtacgttacgtcgacctaccggtacttacgttaccgtctttacgtaccgtctaaccccg

SEQ ID NO: 4700 - DNA, 649 bp, Homo sapiens
  misc_feature: GYAE6OF02GZ2IK.39.31.C09.1.454.CMB.1.raw
  modified_base (276)..(276): a, c, t, g, unknown or other
  misc_feature (276)..(276): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggtccaccatcaactgcaagtccagccagagttgtttacacacggtaccaacaataagaattacttacgtacgttaggtaccagacgagtaaaaccnggaacacgccttactaagttctacgtctaatttactgggactactaccgtaaccgggtagtacccggggtcctgtaaccgtattccaggtcggcgaggtcgggtctaggacgtactaagtactttcacgtctaccaaccgtatacgacgtcaacgccgtacgacgacgtcgtagtaacgacgtgtgcgtaacgttacttacgtacgtacgaacgtcgtaagtagtttactagtacgtaccgtactagtacgttttccgggaccgggtaactaaacggtcgtacgtacgtacgttaacgaaaccggtacggtacgtacgggtaccttacgaccgtaactcgtaccgttccggttacttaccgtaccgtttcccg

SEQ ID NO: 4701 - DNA, 965 bp, Homo sapiens
  misc_feature: GYAE6OF02GFDJ6.39.31.C09.1.454.CMB.1.raw
tcagtcgcactagtcacgaccggtgctcgatttagacgtctcatcaaggaaggaaggggcagcaagatggtgttgcagacccaaggtcttcatttcgtctgttgctctggatctctggtgcctacggggactatcgtgatcgacccagtctccagactcccgtggctggtgtctctgggcgagagggccacatcaactcgcaagtccagccagagttagtttacactacggtacccaaataataaacgtaacttaccgttcgacgtttcggtaaccctagacctaaaggaaaaccccagggtaacctaacggacccctttaccccgttaaaaggttcgacccgtttaacgttaacgttttaacccggtcggggaacctaacgttaaccccggtaaccccgggggttaacggttccccccggggggtaccccttagggtaacccctaaccgtttacgaaccgggtaccggggtacctaaccgggggtccggttacgtacgggtaacggtaaccgtaacggttacgttttaccccgaccgttccggttaccctaacccgtaacgttaccgtaacccgggacctaacccgggtacccgttacggacccggtaaacgggtccgttaacggtaaaaccgggttaggttacgggttaccgggttaccgtttaacggggttttaacccgttttacggttcccgttaacccgggttaagttaaccggttaaacggtttaaaggtttttaaaccgtacgggttaaacgttttcccgttacggttaaacccggggtttacggtttttaacccggggggaacccggggttaaccgtaaacccggttacgtaaccggtaacgttaacggtaacccgttaaaaacgggtccgttaacgggttcggtaaaccgttaggaccccgtaactttaccggttaccccggtttatttacccggtttcaacccgttttcccccgg

SEQ ID NO: 4702 - DNA, 821 bp, Homo sapiens
  misc_feature: GYAE6OF02JSSV9.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggactctcgtggtcgtccggtacgggactacttcggtagtagtccgaacccgtacgttcctaccgaacgtacccgttcccgtggtccttggttcgttccgtcgggtcgggaccggtaacggaccgggaccctaccgtaccgttaccaacgtcgacgtaaccgtccgacgaccgaggttacgtttcgtttaacgacgttacggtaaccgaaataaacgttaaacgttaaccgttaccgttacgtacgtttaccggaaccgacgaaacgaaaccgaaaccgaacggtactacccgtaccgttaaccgttaaagttcgaccttacgttaacgttaccgcggacctacgttacccggtaacccgggtaccgttcccggtacccgtacgtaaccgtacgttaccggcggtacccggtagacggtccgggtccgtaagaccgacgttacgttactttaccgacctacctaccaacgttcaccacgaccgtgtccacgtacgacggtataggagttcgagtcgtacgttatttacgtaccggttagtaccgtagtagtacgttagtattcgtaccgttaccagttaacggttccgggtaccgggttacgaaccggttacgagggtttaacgacacgttaaccggtaaccgtggttacgggtactaccgtaccgtacgtaccgttaggttaccttactttaccgttccgtacctttaccccgg

SEQ ID NO: 4703 - DNA, 907 bp, Homo sapiens
  misc_feature: GYAE6OF02IDWI7.39.31.C09.1.454.CMB.1.raw
  modified_base (118)..(118): a, c, t, g, unknown or other
  misc_feature (118)..(118): n is a, c, g, or t
tcagtcgcactagtcacgaccggtgctcgatttagacgtctcatcaaggaaggaagggcagcaagatggtgttgcagacccaggtcttcattctctgttgctctggactctctggtcnccgtacgggacatcgtgatcgaccagtctccagactccctggctgtgtctcgtgggacgaggacggaccaccgtataccgaaacgttcgacgtaacgtccgaacgaccgtaaggtaggtttacgttttacgaccgtacggttaacccaaacgtaaaagtaaacgttaaactttaccgttcggtcgttttacgggaccaacgaccgtaaacgaaaccgtaacggaacaccgtacccttacccgttaaaggttcgtacctacgtttaacgttttacggacgggtaccttaccgttaccccgggtaacccgggggtaccggttacccccgggggtccccgttacgggtaaccccgttagttacccggaaccggtcccgggacgtaaccgggtccggggtttacgacgggttaacgaccgtaacggttaaccgttttacccactttaacccgacctaaaacccgtcgttaccgaacggaccgtaaccggtcccctagggacccggtaagggtacccttaaagggaacgttagttacgggtacggtaactttaacggtttttacacggttcgtacgtaggttacttaacggtttaactaacgtttacggtaccggtttaaccgtaccgggttaagggttttaccccggttaccggggtaaaccgggacctttaaacgggcgttaaacgggacgttaacgtaacccggaaggttaaccgggttcgtacgggttacctaccgtaacccgttagtaccgtttttccgtaggttaccctttaccgttaccggttcccc

SEQ ID NO: 4704 - DNA, 769 bp, Homo sapiens
  misc_feature: GYAE6OF02FMQ89.39.31.C09.1.454.CMB.1.raw
tcagtcgcactagtcacgaccggtgctcgatttagacgtctcatcaaggaaggaaggggcagcaagatggtgttgcagaccaggtcttcatttctctgttgctctggatctctggtgccgtacgggacatcgtgatgaccagtctccagacctccctggctgtgtctcgtgggcgagacgggccaccagtcaactgacaacgtccacgccagtacgttgtttaacgacgacggtaccaaactaataaagtactttacctcgtacgtttcggtaaccagacctaacgaaaacccagggaaccacggcccttacccttaagttcggaccttactacgtttaacgtcgggctacgtacccggtaaccccggggacggtcccccgggggttaccctggtaaccccggtacttaccggacggtacccggggaccgtacgggtccggggttcgttaggaacggtaaccgttacggtacttttaccgaccttacgtaccctaaccctacgtaccgaggaccgacgggtcctacgtacgtacgggtctaacggtaaacgtacggttcgtacgggtaccgttaagttttacgtacgttcgtaccgtaggttacgtaacgtttagtttagtaaccgtttcgtccttacgtacgtttacgggtttcgggaccggggtacctaagggtcgtagggtacgtactaacggtaacggtacctagggtcggtaccgttcgaaccttcttacgttccgttaccgtcgtttacctaccgttaccccg

SEQ ID NO: 4705 - DNA, 631 bp, Homo sapiens
  misc_feature: GYAE6OF02HY48I.39.31.C09.1.454.CMB.1.raw
  modified_base (398)..(398): a, c, t, g, unknown or other
  misc_feature (398)..(398): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttgtttacacaggtccaaacaataagaacttactcgtcttgtaccgacacgaacgaaaccgaggacacgcctacctagttgctctatttacgtggcgtataccgtacccgggtacggtccgggtcccgtcgaccgtacttcgacgcgcgagcggtcgtcgagacagtactttctactctacacactnacgcgacgtacgtcgtcgagtacgtagtaagtcgtaggtcggacttaagttttaacttctacggtcgaacacgtaagtaatttaacgttagtacgttccctacgtaaggttaccggtttcgggaccggggaaacctaaggcgtgggtaacacgtaacgaaaaccggtacgttcggtacgcgttaccgactaacccgttattcccgttaggttcctttaccgatttacccccgg

SEQ ID NO: 4706 - DNA, 828 bp, Homo sapiens
  misc_feature: GYAE6OF02H7250.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagactcccgtggctgtgtctcgtgggcgagacggccaccatcaactgacaacgtccagccagtagttgtttaacacgtacggtaccaaacaaataagtaacttacgttccgcgtttacggtaccaagtccgaaacggtaaaaccgagggaacacggtaccccttacccgttaaaggtttcgtaccttacctaattttacccggtgggggtacctaacgttcccgtaacccggggtacggttccccggggtccctacggtaccgtattccgaggtccggcacggtccgggtactaggacgacgtaaggttacttttcgaccttaccgtaccctactactaccgtacgacgaccgtccgtacgaccggtaacggtacgttaaggaacgttacggtcggtacggtaccgtttaggtttttaacgttaccgttacggttacctaagggtactttaacgttaagttttaagttacgggttaaccgttaaccgtttcggtaaaccgtttaccgggttttacccgggggaaacccggggtaacgtaacggtaccggtaaggggtaacttaaccggtaaccgtaaaccggtaaccggttacgggttacggtacccgttacggaaccgttacccttacggttaccgtttaccggtttaacctttacccgtaccgttttaccccccgg

SEQ ID NO: 4707 - DNA, 800 bp, Homo sapiens
  misc_feature: GYAE6OF02IYSP9.39.31.C09.1.454.CMB.1.raw
  modified_base (129)..(129): a, c, t, g, unknown or other
  misc_feature (129)..(129): n is a, c, g, or t
  modified_base (144)..(144): a, c, t, g, unknown or other
  misc_feature (144)..(144): n is a, c, g, or t
  modified_base (335)..(335): a, c, t, g, unknown or other
  misc_feature (335)..(335): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggganatcgtgatcgacccngtctccagactccctggctgtgtctcgtgggcgagacggccaccatcaactgacagtccagccagtagttgtttacacgtacggtaccaaactaataaagtaattaccgttcgtacttacggtaaccaggacctaacgaaacccgaggaaccacgtacccctacttaagttagccttacttaatttacggngggtactacgttcccggtaacccggggtacggtaccccggggtccctacggtacccgttagttacgacggccggacgtacgggccggttacgtaggacgtaaccgtacgtacgttttaccaccttaccgtaccaacctacgtaccgtacgtacccgtaagcccgttacggaccggtacggtaccgtaggtaaacggtacgttacggtacggtaacggtttaacgtttaacgttacgttaacgtacgtaacgtacgttaaacgttaagtttaacgtaagttaccgttaccgttaccggtaaccggtttaccggttttaccgggggaacccgggttaaacgtacggtaccggttaagggtaacgttaccgtaacggtaaacggttaacggttacggtaccggtaactccggtaaccgtaaccgtcgtttaccgttacgtttaaccgtttccgtacccgtttaccccg

SEQ ID NO: 4708 - DNA, 701 bp, Homo sapiens
  misc_feature: GYAE6OF02HWW7N.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctccctggctgtgtctcgtgggcgaggaggacccaaccatacaactgacaacgtccacgccaaggtagtttacgttttaacgacgaacggtaccaaaacaaagtaaacgtaactttacgttcgtacgttaggtaccagacaacgaaaccgaggacacgtacctacgtaagttcgacttacgtatttacggaggtactacgttcccgggtaacccgggtccgggttaccccggggtccctacggaccgtagttccgacggcggacgacggtcggggtactaggaacgtacgtagttacttttacccgacctttacctacccgaactacgtacgacgtacgacgtccctaggcgacggtcgtaggtaagtacgtggtacggtacttagttttaactacgtagtcacgtattagtaattacgtagttaccgtactaccgtaagttccggttacggggaccgggtaacgacgtcgtagacgtactaacgtaacgtgtcggtacgcgtcgaccgtacgtacgttcgttacgttcttactaccgttccccg

SEQ ID NO: 4709 - DNA, 658 bp, Homo sapiens
  misc_feature: GYAE6OF02I8B5Q.39.31.C09.1.454.CMB.1.raw
  modified_base (315)..(315): a, c, t, g, unknown or other
  misc_feature (315)..(315): n is a, c, g, or t
  modified_base (618)..(618): a, c, t, g, unknown or other
  misc_feature (618)..(618): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagacggccaccatcaactgcaacgtccagccagagttgtttacacgacggtaccaacaataagaacttacttcgacttcggaccagtacgaacgaacgagacacgtacctacgttacgtcgtacttacgttacttacggngtactaccgtacccggtaccgggtaccgggttccccggtactaccggtacgttacgtcgacggaccggtacgacgggtaccggtcgtagaccgaacgtacgttacttacctacgtacctaccaacgtacgaccggtacaccgtccgtcgacgacggtacgacgtaagagtagtcggtagtactttacgttattacgtgtacgtacgtactaattacgttagtaccgttctacgtttacgtacggtttacggtaccggggaccgtaagacggtacgacgtactacgacgtaacggtctggtacncgtacgacgtacttgtccgtatttcctactccgttacccg

SEQ ID NO: 4710 - DNA, 724 bp, Homo sapiens
  misc_feature: GYAE6OF02G0OXU.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctccctgctgtgtctcgtgggcgaggacggccaccatacaactcgacaacgtccacgacctagtagttacgttttacacgacgtaccaaactaaataagtaacttaccgttacgtcgttacggaccagaccaacgaaaccgacgacacgtccttacgtaggttcgctacttaacgtttacgtgggtaccacgttaccccggtacccgggggtacggttccccggggtacccctaggaacccgttacgttccggaacggtccggacgtcgggccggttactaggaacgtacgtacgttaactttcccgaacttccgtaaccacctacgtaccgacgtacccgtacgtccgtcggaccgtagggaccgttaaggaacgtggttacggtacggtagtttaacggtttacttaacgttcgtacgaacgttacgtagttaattaggtacgttcgtaccgtcgtaacggttcggttacgggaccggtacgtacgcgtagacgacgtaacgaacggtccgtggtaccgtacgtcgaacctaccgttctacgttctacctttacgtacccttcccg

SEQ ID NO: 4711 - DNA, 834 bp, Homo sapiens
  misc_feature: GYAE6OF02JV1TB.39.31.C09.1.454.CMB.1.raw
  modified_base (181)..(181): a, c, t, g, unknown or other
  misc_feature (181)..(181): n is a, c, g, or t
  modified_base (230)..(230): a, c, t, g, unknown or other
  misc_feature (230)..(230): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctcccgtggctgtgtcgtcgtgggcgnggacggccaccatcaactgacgaacgtccagccaggagttcgtttaacnctacggtaccaaacgaattaacgtaactttacgttacgtacttacggtaccagtacgaacaaaccggaggacacggtccctcttaagttcgtactacttacgttacgtacggctacgtcccggtaccggggtaccgtccgggttccctaggaccctagttaccgcggtaccggcgaacgggtccggtacgtgaacgtaccgtattcgttctaaccgtcctacgtaccgtaacgtcgaacccgtcgtaaccgtcccgtagggtaccgtacgggtaaccttaaccgggtaaaggttacggttacggtaacgggttaaccgttttaacggttttaacgttaccgtttacgaccggttacggtaaccgttaaggtttaacgtttacgtagtttacccgggttacccttacggtttaaccggttccggggttttacccggggaaccggggttaaccggtaacggttacccggttaagggtaccggttaaccgtaaccggtaaaacccgggttacggtttaccgggtaacgtaaccgggtttccgtacccggtaacgttacccgtttaacgtttacccggtttaaccgtttcccggttagttacccccgg

SEQ ID NO: 4712 - DNA, 563 bp, Homo sapiens
  misc_feature: GYAE6OF02FQHAY.39.31.C09.1.454.CMB.1.raw
  modified_base (322)..(322): a, c, t, g, unknown or other
  misc_feature (322)..(322): n is a, c, g, or t
  modified_base (400)..(400): a, c, t, g, unknown or other
  misc_feature (400)..(400): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacgaggtccaacaataagaattacttcgcttggtaccagcaagaaaccaggacagcctacgtaagttgctcatttacgtggcatcgtacccgggagtccgggtccngaccgattcacgcgcaggcggtctgacgacagtactttcactcctaccacgatcgagtcagcctgcgacggcagaagntggtcggactagtttacttacgtgtctagctagtattagtacgttactcctgtagttcgtttcgggaccgggtacgacgtcgtacggtactacgtagaaccgtacgttggtacggtcctagtacccacgtacgttaccgtgttaccttactacgtttaccccg

SEQ ID NO: 4713 - DNA, 724 bp, Homo sapiens
  misc_feature: GYAE6OF02HZF73.39.31.C09.1.454.CMB.1.raw
  modified_base (327)..(327): a, c, t, g, unknown or other
  misc_feature (327)..(327): n is a, c, g, or t
tcagtcgcactagtcacgaccggtgctcgatttagacgtctcatcaaggaaggaagggcgagcaagatggtgttgcagacccaggtcttcatttctctgttgctctggatctctggtgccgtacgggacatcgtgatcgacccagtcctccacgacctcccgtggctgtgtctcgtgggcgaggacgggccaccataccaactgacaacgtaccacgccaagtagttagtttaccacgacggtaccaaacaataagaactttactcgtcttacggtaccagacaacgaaacaggacacgcctacgtaagtcgctactagtttaccgnggcctacgtaccgtacccggggacggttacccccggtcctacggaccgtacgttaccgagggtccggaccgtacggtaccgggtctacggaacgaacgtagttactttaccgaccgtaccgtacccacctagtaccgacgtacgaaccgtccgtagaccgacggtaccgttaaggaaagtaccgttgggtcggtaacttttaaggttttaacttacgttacggttacgaagtaacgttaagttaacttacgtttaagtaccgtttaaccacgtttaaccggttacggtttaccggggaaccgggtaccctaaaggcgtaggaactacgacgtaaacgcggtttagccgtaacgtcgaaacgtccgaattaccgtggtttacctacttccgttacccg

SEQ ID NO: 4714 - DNA, 614 bp, Homo sapiens
  misc_feature: GYAE6OF02F2K7K.39.31.C09.1.454.CMB.1.raw
  modified_base (309)..(309): a, c, t, g, unknown or other
  misc_feature (309)..(309): n is a, c, g, or t
  modified_base (347)..(347): a, c, t, g, unknown or other
  misc_feature (347)..(347): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggcccaccatcaactgcaagtccagccagtagttgtttacacaggtaccaaacaataagtaattaccttcgtcttcggaaccagacaagaaaccaggacacgtcctcctaagttgctactatttacgnggctagtccgtaccgggaggtcccgggtcctgaccgtnttcgagcggcaggtcggtcgtagacgactagtactttcgacttcacacctatacgacgacncgtccngccggaggtctaacggaagtgttgggtcgggtaactttagttttactcggtagtccaaggttcttaagttacttagagttaccgtacctgtacggtttacggttccggggaaccgggtacaggtcgtagagtacctaaacgaaccgtcgtggtaccgtcgacgtactacgttattccgttatcccttctacccgttcccg

SEQ ID NO: 4715 - DNA, 859 bp, Homo sapiens
  misc_feature: GYAE6OF02JQ4R3.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatcgacccagtctccagacctcccgtggctgtgtctcgtcgggcgacggagggccactatccaactgacaacgtccagtccaggtagttcgtttacacgtacggtaccaaacaaacttaaagtaacgtttaaccgtcgtacgtttacggtacacgacgaaacgaaaaccgaggaacgacgtcctaaccttaagtcgctacgttaacttacggcggtacctacgttacccgtacccgggtacgtcccgggtacccgtcgaaccgtgtaccgacggccggcgacggcgggtacgtagacgaacgcgtttacttaaccgtcaccgttaccaaccgtactacgaaccgccgtacggtaccgtaggacggtaacgtacgtaaagggtaaccgttaagtccgggttacgtaacgttttaacggtttaaccgttaaccggttcgtaacggtaccgttacggttaaaacgttagtttaaccgggttaacgttaccggttacccgttaaaccgggtttacgtttaacccgggggttacggggtaaaccccggggttaaccggtaacggttacggggtaacggttaaaccggtaccgttaaaacccggtaaccggggtttaaccgtcggggggttaccctaacgttaacccgggtacccgttaaaccccgtcgggttttaaacccgttccggtttaaccccggtttacccgttttaacccggtttaacccccccg

SEQ ID NO: 4716 - DNA, 908 bp, Homo sapiens
  misc_feature: GYAE6OF02HMUB1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtcgaccgtacggggacatcgtgatacgacccagtcctccagacctccctggcttgtcgtctcgtgggcggacggacgggacccaaccaactactaacgtgaccgtaacgtaccacgaccgtaagtacggtttacgttttaaccacgaacggtaacctaaaacgaaacgttaaacgtaaatttaccgttacggttaccgtttaccggtaaaccaacgacgtaaaacggaaaaaccgaacggaaccaacggtaccccttaccgttaacggttacgtacttacctttaacggtttaaccggtacgggtaaccgttacggttaaccccgggttaaccccgggggtacccgggtttccccgggggtaccccgttaccggtaacccgttacgttaccgtaacgggaccggtacggtaccgggtccgggtacgtaggaacgtaccgtagttaacgtttacccgtaacttaccgtaacaacccgtaactaccgtaacgaccgtaccgtaccgtacggtaccggtaaggtacgtaaggaaggtacgttaggttaacgtaccgttttaacgtttaacgttacgtttaacggtacgtacggtaaattaacgttaagtttaaaccgggttaacgttaccggttaacctttacgtaacgggtttaccgggtttaaccgggggaaccgggggtacctaaacgggtaccggttaagggtaccgtaacgtaaaccggtaaacgtaacggtcgtaacggtccgacgtacctacgtacgttaccttcgttaacgttaccgtcttaccccg

SEQ ID NO: 4717 - DNA, 616 bp, Homo sapiens
  misc_feature: GYAE6OF02JKQOK.39.31.C09.1.454.CMB.1.raw
  modified_base (570)..(570): a, c, t, g, unknown or other
  misc_feature (570)..(570): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggacgggccaccatcaactgcaagtccagccagagttcgttttacacacggtaccaaactaataaagaactttacttcgtacttcggtaaccagtacaacggtaaaccaggaacacgccttaccgttaagttcgccttacgtactttacgtcgggctacgtaccgtacccggggtacggtccggggtcctggacccgtattcacggcggtcgagccggtctagacgtacagttcttcactctacacatcagcacgctcgacgtacggctaggtaacgagttcggaggtactacgtttacgttacttgtacatcgtagttattacgtagtcctacgttcgtacgttacgtttccgggacgggtacaaggtcgtacgtagacgtaacacgtaacgngttacggcgttacgccacgtattccgtacgttcctcttacgttccc

SEQ ID NO: 4718 - DNA, 720 bp, Homo sapiens
  misc_feature: GYAE6OF02HWDR4.39.31.C09.1.454.CMB.1.raw
  modified_base (327)..(327): a, c, t, g, unknown or other
  misc_feature (327)..(327): n is a, c, g, or t
  modified_base (366)..(366): a, c, t, g, unknown or other
  misc_feature (366)..(366): n is a, c, g, or t
  modified_base (476)..(476): a, c, t, g, unknown or other
  misc_feature (476)..(476): n is a, c, g, or t
  modified_base (490)..(490): a, c, t, g, unknown or other
  misc_feature (490)..(490): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacgggacatcggtgatcgacccagtcctccagcctcccgtggctgtcgtctcgcgggcgaggacgggtcccaaccgataccaacgtcgacaacggtccgacgtaccgtagtaggtttccgtttaaccgacgtacggttaacccaaataaactaaaggttactttacgttcgtaccgtttaggaccaggacctaaacggaaaccnggacaacgtcccttagtaacgtgacctcgtaatttacgnggctaacgtccgtacccgggtaggttccccggtctacggtaaccgtctcggaacggcgtacggtcgggtccggttcaaggtacgaacgtgttacctttaccgactcctanaaccgtacgttacncgacgtaccgcgtagcgtacggcgtaagcgtagtgagtccgttagttacnccttgnacgtcgattagtcagttcctacgtcgtaacgttccggttacgggacccggtaacgagttcggaacggttacacggttacccgtaaacggtggtaccggtcgtcccggttaacctaacccgggaccttcgttacccgtttccggttaacctcccgggttaccctttaacccccgg

SEQ ID NO: 4719 - DNA, 785 bp, Homo sapiens
  misc_feature: GYAE6OF02IZH92.39.31.C09.1.454.CMB.1.raw
  modified_base (391)..(391): a, c, t, g, unknown or other
  misc_feature (391)..(391): n is a, c, g, or t
tcagtcgcactagtcacgaccggtgctcgatttagacgtctcatcaaggaaggaagggggcagcaagatggtgttgcagacccaggtcttcatttctctgttgctctggatctctggtgcctacggggacatcgtgatgacccagtctccagacctccctggctgtgtctcgtgggcgagaggccaccatcaactgcaagtccagccagagttgtttacacaggtaccaacaaagtaagtaattaccttcgtacgttcggtaaccagacaacgaaaccaggacagcctaccgtaagttgacctactattttacgcgggactacgttaccgtaacccggggacggttccccgggggtaccctacggaacccgtcgttacgcggaccggacgnggtaccgggttctagacggactaacggttactttacaaccgttctaaccctacctacgtacgaacggacctaacgtccccgttacggaccgaacgggtactaacggtaaacggtagttcggtacgggtaacctttaggttttaactttaacggttcgttaccgtaaggttactaaaggttttaaactaacgtttaaacggttacctttaccgtttaacggtaaaccggtttttcccggggttttaaccgggggaccgggggtaaacccctaaagggttaccgacggggtaaacgtaaccgtaaaccgtaaaacggtaacggttacggtaccgggtaccacggtaacccaaccgttagtacccggttatttacccgtttactaccctttccccgg

SEQ ID NO: 4720 - DNA, 700 bp, Homo sapiens
  misc_feature: GYAE6OF02FNNEG.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctcagactcccgtggctgtgtctctgggcgagaggccacatcaactgcgaacgtccaggccagtacggttgttttacacgtacggtaccaataaactaaagttaacttaccgttcgtcgtttacggtaaccaggacaaagaaaaccgagggaacaccgaccttacctaaggttacgtccttactacttttacggtcgggtacctacgttacccggtacccggggacgggttcccgggggtaccccgtacggaccggtactttcggaacggtccggacgtacgggtccggtctaggtacgacgtacgtatttacgtaccttacgacctaaccgtactccgacggtcacgtccgtacgcgtaacgtcgtacgaagttggtagtcgggtacttagttacgttacttgtcgtactagtagttaattacgtacgttagtccttagtaccgtttacggtttcgggaccggggtacaggtacggtcgaacgtacgaacggtaacgtagtgttacggtccgtacgactacgtacgtccgttaggtccttacttgttaccccg

SEQ ID NO: 4721 - DNA, 582 bp, Homo sapiens
  misc_feature: GYAE6OF02JJRON.39.31.C09.1.454.CMB.1.raw
  modified_base (294)..(294): a, c, t, g, unknown or other
  misc_feature (294)..(294): n is a, c, g, or t
  modified_base (350)..(350): a, c, t, g, unknown or other
  misc_feature (350)..(350): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctacctaagttgactctatttacgnggcctatccgtaccgggagtccggggtcctgaccgattcaagcggacaggcggtcngacgacagtatttcactcgtacacatacagcagcctgacagtctagaagagtgtcggtatagtttacttacgttgtacacgtctaagttattagtagtacgtcctacgtaacgttacggttttacgggaacccgggtacgtaaacggtccgtaggtaactacgtacgaaacgtaacgtagtacggtcgtacgtaccgaccgtactacgttagttacctacctacgttccccg

SEQ ID NO: 4722 - DNA, 923 bp, Homo sapiens
  misc_feature: GYAE6OF02F9BGM.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctcctggctgtgtctcgtgggcgaggacgggccaccatcaactgacaagtccagccagagttagtttaacacgtacggtaccaaacaagtaagtaactttaccttacgtcgttacggtaaccagaccaaagtaaaacccaaggaaccacggtacccttacccgttaaagttggacctttacttaacgttttaaccgtacggggaccttaacgttaccccgggttaacccccgggggtaccgggtttaccccggggggtttacccccgttacgggtaaccccggtaaccgttttccgaaacggggtccccgggtacggtaaccgggtccgggggttacctacggggaacggtaacctaaaggggtttaccttttacccgaaccgttcccttaacccgtaaccctaacttacccaacggaacctcggtaccccggtacgtaccgggaacgggttaccgtaaggtaaaggtacggttacgggtacgggttaccgtttaacggttttaacgtttacggttacgttaaaccgtaacggttaccgttaagtttaaacgttttaacgttaacggttaccgtttaccgtaccgttaacgttaccgggtttttaaccgggggacccggggttaaaccgtaacggtacggtacgggtaaccgttacggtaaccggtaaaaccggttaacggttacggttaccgggtaccgttacggtaccgaacccgttacgttacccgttacgttttacccgttaacccgttacgttttaccccccgg

SEQ ID NO: 4723 - DNA, 646 bp, Homo sapiens
  misc_feature: GYAE6OF02GAF4Z.39.31.C09.1.454.CMB.1.raw
  modified_base (302)..(302): a, c, t, g, unknown or other
  misc_feature (302)..(302): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagtagttgttttacactaggtaccaacaataagtaattacttcgcttggtaccagacaagaaaccaggacacgcctactaagttgctctattacgnggcatccgtaccgggacgtccgggtcctgaccgtattcgagtcggcaggcggtctgacgacagtactttcactctacactactacgacgtcgacgcctagaccgtaggactacggtaagtagtggtacggtacgttaagtttacgttacgttcgtacgaagtactaagttatttacgttaacgttacgttaccgtacgttaacggttcggttttaccggggaccggggtaacctaaggtaccgtacgggagttacgtaaccggtaaaacgtacggttacggtacggtaccgttacgaccgtacctacgtttacgttcgttaccgtttacctaccgtttaccccg

SEQ ID NO: 4724 - DNA, 736 bp, Homo sapiens
  misc_feature: GYAE6OF02IFTNM.39.31.C09.1.454.CMB.1.raw
  modified_base (714)..(714): a, c, t, g, unknown or other
  misc_feature (714)..(714): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgaccagtctccagacctccctggctgtgtctctgggcgagagggccaccgatcaactgacaagtccaagccaggtagttgttttaacacaggtaccaaacaaataaagtaattacttccgctttacgggtaccaagtcgaagaaacctgggaacacgcctaccttaaagtcgcttactaactttcgacgggctaacgttccgtacccgggaggttcccggggtccttcggaaccctgttaccgacggacggcgaagggtccgggttactggaacggtacaacggttactttaccgacctaccgttcaacctagttaccaaacggcaacggccttaggaccgaacgggtacctttaaggaaaccgttggttaaacggtcgggtaaccctttaggtttttacgaacttttccgggaccttagtaccgtaatttagttaaaccgtagtttacggtacccttaggtaacgttttacgggttttccggggaacccggggtaactaaacggccggttaaaggcgtaacgtaacgtaaaacggtcgtacgtaccggtagtccgaacctaccggattacccggttntaacccgtttaaccgtttcccc

SEQ ID NO: 4725 - DNA, 802 bp, Homo sapiens
  misc_feature: GYAE6OF02I1JS6.39.31.C09.1.454.CMB.1.raw
  modified_base (335)..(335): a, c, t, g, unknown or other
  misc_feature (335)..(335): n is a, c, g, or t
  modified_base (371)..(371): a, c, t, g, unknown or other
  misc_feature (371)..(371): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtgatcgacccagtcctccagacctccctggctgtgtctcgtgggcgagacggccaccatccaactgacaacgtccacgccagtagttgtttacacgtacggtaccaaacaagttaaagaactttacgttcgtacgttacggtaaccagacaacgaaaaccgaggacaagccctacctaagttcgactacttatttaccgnggactacgtccgtaaccgggcggtcccgggttcccncggtaccgtagttccgacggccggtcgacggtccggtctaggtaacgacgtaacgttactttaccgaacttccgtaccaacctacgtaccgacgtaccacgtccgtacaccggtacggtcgtaaacggaacggttaagttcgggttaacgggtcgttttaaacgtttacgtacgttacggtaccgaagttaccgttaaagtttaactttaacggttaacggttaccgtttacccgttaacggttaacggttttaccgggggtttaacccggggacccggggtaaacccgttaaggttaccggtacgggtaaacgtaccggttaaacgtaaacccgggttacgttaggggtaccggttaaccgtcgtaacccgtaacccgtttaccggtttaccggtttacggtacccctttacggttacccgtttcccccg

SEQ ID NO: 4726 - DNA, 689 bp, Homo sapiens
  misc_feature: GYAE6OF02JISO7.39.31.C09.1.454.CMB.1.raw
  modified_base (309)..(309): a, c, t, g, unknown or other
  misc_feature (309)..(309): n is a, c, g, or t
tcagtcgcactagtcacgaccggtgctcgatttagacgtctcatcaaggaaggaaggggcagcaagatggtgttgcagacccaggtcttcattctctgttgctctggatctctggtgcctacgggcatcgtgatgacccagtctccagacctccctggctgtgtctcgtgggcgaggacgggccaccgatccaactgcaacgtccagccagtacgttgtttaccacacggtaccaaacaagtaacgtaattacttcgtcttaggtaccagacgaacgaaaccaggacacgccctacgtaagttcgcgtntacttacgtgggactacgtccgtacccggacggtcccgggtcctacgacgtacttcgacgtcggcgcggtacggtcgtagaccggtactaggtactttaccgacttaccgtactacccgtactacgaacgtcgtaaccgtccgtgtaccgacggtcgtaacggaaggtagttggtacggtagttaacgttttattacggttatacgtaccgtagttaagttaacttagtttacggttaacggtcccttacgggtacgttaacggtttaccggggaccggggtacctacggtacgtgggtaacgtacgaacggtaacgtaacggttacggtcggtactcgacctaccgtacttccgtacggtccctttacgccgttacccg

SEQ ID NO: 4727 - DNA, 628 bp, Homo sapiens
  misc_feature: GYAE6OF02GN4KL.39.31.C09.1.454.CMB.1.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
  modified_base (545)..(545): a, c, t, g, unknown or other
  misc_feature (545)..(545): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctgctgtgtctcgtggcgaggaggcccacatcaactgcaagtccagccagagtntttacacaggtaccaaanaataagaattactcncttggaccagacaagaaccaggacacgcctctaagtnctcatttacgnggcactccgtaccggngtcccggtccagaccgtatcgagcggcaggtcggtctgaacgtcgagttactttcaccctgtaccacctactacaacgcccgaagtcctcgtaccgagtaccgtaaggtaacgacgttagggtagttaccggtaagttttacgttaacgttcgtacgtacgtaccgttaagttaatttaacgttagttccggtactacgtaacgttacggtttcgggacgggtaacccaaggtaccggnggaacgtacgtacgtaaaccggtaacgttacggtcggtacgtcgacgtacctcgttccgtactttccgttactaccttcccgg

SEQ ID NO: 4728 - DNA, 815 bp, Homo sapiens
  misc_feature: GYAE6OF02H7UQ7.39.31.C09.1.454.CMB.1.raw
  modified_base (164)..(164): a, c, t, g, unknown or other
  misc_feature (164)..(164): n is a, c, g, or t
  modified_base (730)..(730): a, c, t, g, unknown or other
  misc_feature (730)..(730): n is a, c, g, or t
  modified_base (785)..(785): a, c, t, g, unknown or other
  misc_feature (785)..(785): n is a, c, g, or t
tcagtcgcactagtcacgaccggtgctcgatttagacgtctcatcaaggaaggaagggcagcaagaatggtgttgcagacccaggtcttcatttctctgttgctctggatctctggtgccgtacggggacatcggtgtatcgacccagtctccacgactccccnggtcgtgtcgtcgtcgtgggcgagcgggccaccactactaacgtgacgaacgtccacggccaacggtaggttacgtttttaaccgaccgttacgggtaacccaaaataaaacgtaacgtaaactttaacgttccgtacgttacgggtaacccagtaccaaacgaaacccgaaggaccctactaccgttaccgttaaagtcgtccgttaacttaacggttacgtaccgggtactacgttaacccggtcccggggtaagggtccccggggttccccgtaaccggtaaccgttaacgttccgaacggcccgggtaccgtacggtaccgggtactacggaagtaaccttaccggtacttttaacgacctcgtaacaaccgtagttacccaacggtaccaccggtccgtaacggtaccgaccgggactttaagggaaacgtacggtgggtaacggttcttaaaccggttttaatccggtttacgtaacgaaccgttaagtaacggtttaacttacggtacggttaacttacccgtacgtacgggtttacccgtttcggggacccgggtacncgggttaacggtagacctaacgtacgtaaaccgtggtaccgtcggaacctcgacncgtaccgtcttcggtcttacgccttacccg

SEQ ID NO: 4729 - DNA, 949 bp, Homo sapiens
  misc_feature: GYAE6OF02GIILN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtcgccgtacgggacatcgtgatcgacccagtcctccagacctcccgtggtctggtcgtctcgtgggcgaggacggacccacctataccgtaactcggaccaagtcccgacgccgtaaggtacggtttacgttttaaccgaacgtaaccggttaacccaaaactaaagtaaacgttaacttttacccgttacgtacgttacggtaccgaagaccgtaaacgaaaacccgaggaacctaccgtacccgttaacttaacggttcgtacccttacgttaacgtttacggtaccgggtaccttaaccgggttaccccggtaaccccgggggtaccgggtttacccccgggttaccccgttaacggtacccgttacgttaccggaccgggtaccggtaccggaccggttccggggtcctaacgggaaaccggttaacggtaacgtttaaccttttacccgaaccttaccgttacccctaaaccgttaaccttccggaaacgtacccgtacccggtaccgttagggaacccggtcggttaacggtaacggtaaggtaggttaccggtaccggttacggttttacgtttaccgtcggttacttacggaaccgtttaggtaacgtttaatttaccgttaccgggtttacttacccgggtttaacgttaccggggttttaacccggtacccgggggtaaccgtaaccggtacggtttaaccgggacgggtaacctttaaccggtaaaccgttaacggtacggttacggtacgtaaccgaaccgttacccttacggtacgtttaccgtttaccgttaccggttaccccttaccggtttaccccg

SEQ ID NO: 4730 - DNA, 719 bp, Homo sapiens
  misc_feature: GYAE6OF02FHAT4.39.31.C09.1.454.CMB.1.raw
  modified_base (237)..(237): a, c, t, g, unknown or other
  misc_feature (237)..(237): n is a, c, g, or t
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggcccaccatccaactgacaacgtccagccaggtagttgtttacactaggtaccaaanaataagaattacttcgcttgtaccagcaagaaaccngacagcctactaagttgctcatttacgnggcactccgtaccggcggtccgggtcctaggaccgtattacgcggtcggcacggtcggtctaggacgtacgacgttactttcaccgtctacgacctaatccgacgtaccgacgtcccgtaggaccgtagggtacctaagggtaaacgtaggttcgggttaccggttaacctttaagggttttacctttacggttcggtaccgaacggttacgttaaccggtttaattttaaccgggttaacgttacccggttaaccgttaccggttaaccggtttaccgggttttaccgggggaaccccggggtaaactacggttcggtaacgaacgttacgtaaccggtaaaccggtacgttggtaccggtcctaccgtaaccgtaccgtacgttaccgttccgtactttaccgacctttaccccgg

SEQ ID NO: 4731 - DNA, 525 bp, Homo sapiens
  misc_feature: GYAE6OF02IQ6TI.39.31.C09.1.454.CMB.1.raw
  modified_base (242)..(242): a, c, t, g, unknown or other
  misc_feature (242)..(242): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (365)..(366): a, c, t, g, unknown or other
  misc_feature (365)..(366): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
  modified_base (419)..(419): a, c, t, g, unknown or other
  misc_feature (419)..(419): n is a, c, g, or t
  modified_base (497)..(497): a, c, t, g, unknown or other
  misc_feature (497)..(497): n is a, c, g, or t
  modified_base (505)..(505): a, c, t, g, unknown or other
  misc_feature (505)..(505): n is a, c, g, or t
tcagtcgcactagtcacgaccggtgctcgatttagacgtctcatcaaggaaggaagggcagcaagatgtgttgcagacccaggtcttcattctctgttgctctggatctcgtggtcgcctacgggacatcgtgatgacccagtctccagacctccctggctgtcgtctcgtggcgacgaggccacatcaactgacaagtccagccagtagtgtttacactgccaaacaataagattactcgnttgaccagcagaacagacacgcctactaattgctctagttactggcaagtctaaccggtaccggtccngactcgtnagccggtnagtcggctgaagtacngtnttacactcacgcctaagcannacgtcctgcagctagatcngttcgntacgttatnacgtcangatatacgttanacgttctactaacgttcgtttccggaacgggtacgtaagagtagtacgacgtataaacgcggtatgggaacctcgtanacccgtanacgtactcgtcaggttaccc

SEQ ID NO: 4732 - DNA, 736 bp, Homo sapiens
  misc_feature: GYAE6OF02G614Z.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatccaactgcacgtccagccagagttgtttacacacggtaccaacaataagaattacttcgacttcggtaccagacaagaaaccaggacacgtacctacctaagttgacctctattttacgtgggacctacgttccggtacccgggtacggtcccggggtcccctaggacccgtattaccgacggccggcgacggtccggggttactacgggaacgtaaccgtaacggttacttttaccgaccttaccgtaccgtaaccctacgtaaccgacgacccgttaagccccgtacggccgtacgggaccgtaaggtaacggtagttacggttacgggtacgtttaaggttttacctttacgttacgtacggtacgtacgtaagttaacgtttaagtaacgttacgtaccgttacgtacgtttaccggttttacgggacccggggtacgtaggtacgtacggacgtacgaacgtaaacgtacgttaggtacggtaccgtacgtaccgtaccgttacgtaccgtttaccggttacctttacctacgttaccccg

SEQ ID NO: 4733 - DNA, 644 bp, Homo sapiens
  misc_feature: GYAE6OF02HQFOD.39.31.C09.1.454.CMB.1.raw
  modified_base (388)..(388): a, c, t, g, unknown or other
  misc_feature (388)..(388): n is a, c, g, or t
  modified_base (525)..(525): a, c, t, g, unknown or other
  misc_feature (525)..(525): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcggacccagtctccagacctccctggctgtgtcctcgtggcgagacgggccaccatacaactgacaacgtccagaccagacgttgtttacacgtacggtaccaaacaaataacgaattacttcgtcttacggtaccagcaacgaaacgaggacacgccctactaagtcgctctaatttacgcgggctacgtaccgtacccgggacggtccccgggtcctggaccgtattcgaggcggacaggcgggtacncggagaactagtactttacacgtctaccaacactcacgcgacgcctacgacgacggacgtacgaagtagtggtacgacgttaagtttagttcgttagacgtagtaccgttaagtactttaagtcgttactaccgttntacgttacgggtttacggggaccgggtacgaacgtacgtagggacgtacgtaacgtaacggtaacgtggtacggccgttagaccacgtacttcgttcgttacgtttccgtacttacccg

SEQ ID NO: 4734 - DNA, 884 bp, Homo sapiens
  misc_feature: GYAE6OF02IW5B5.39.31.C09.1.454.CMB.1.raw
  modified_base (181)..(181): a, c, t, g, unknown or other
  misc_feature (181)..(181): n is a, c, g, or t
  modified_base (502)..(502): a, c, t, g, unknown or other
  misc_feature (502)..(502): n is a, c, g, or t
tcagtcgcactagtcacgaccggtgctcgatttagacgtctcatcaaggaaggaaggggcagcaagatgggtgttgcagacccaggtcttcatttctctgttgctctggatctcgtggtgcccgtacggggtacactcggtgatgacccagtcctcagactcccgtaggcctgtctctcgngggccgtaggacggaccaccactacgaacttgacgaacgtccgaacgtcccgtaagtacggttacgttttaccgaacgtacggttaacccaaaactaacgttaaaacggttaaacctttccggttacgtaccgtttaccggggttaaccagtaaccgtaaacggaaaacccgacggttacccgacggtaccccttaaccccgttaaggttaccggtaccgtacttattttaccggaggtcctacggtaccgggtacccgggtacgggtcccggggtaccctacggtaccgaactgtacggcgtaccggcggtccggttacngtaacggactacgttaccgtacacttccgtaaccgtactcgtaacgaccgtaccgaggttaacccgtcggtaacctagggtaccgttaaacgtaaaggtacggtacccgggttaggttaaccggtttaaccgttttagttaacccggtcgttaacgtccggtaaccgttagttacggttttacctaaacgggtctttacccggtacggttacgggtttaccggggttaacgggtacccgggggtaaaacccaaggggtttcgtaacgggaacccgttagttaaaaacccgtacccgggttaaagtccgggggttaccgttaacgggaccctaccggttaacgtcgttaccctttaaccgggtcttcccgtaaccccttcggg

SEQ ID NO: 4735 - DNA, 776 bp, Homo sapiens
  misc_feature: GYAE6OF02FJXVQ.39.31.C09.1.454.CMB.1.raw
tcagtcgcactagtcacgaccggtgctcgatttagacgtctcatcaaggaaggaaggggcagcaagatggtgttgcagacccaggtcttcatttctctgtgctctggatctcgtgtgcctacggggacatcgtgatgacccagtctccagacctccctggctggtcgtctcgtgggcgaggacgggcccaccatacaactgaccaagtccagcctaggtaagttgttttaacacgtacggtacccaaaacgtaaataaacggtaaatttaaccgttcgtacgtttacggttaaccagacctaaaggaaaccccgaagggtacccacggaccccttaccgtaaacggttgccttacttacgttttacgcgggtacctacgttaccccggttacccggggacggttccccgggggttaccctcggtaaccgttacgttccgtacgggccgggtaccgacgggtcgggtacctaggaaccgtacgtacgttactttccgaccttccgtaccactacgtacgtacgtacccagtcctaggtacgacggcgtaaaggaagaagttcggtagtaccgttaagtttaacgttaccgtacgtacgtacggacgttacgttaagttaagtacggttacgttacccttacgtacgggtttaaccggtttccgggggaacccgggtaccgacggttgtacggagtaacccgtaacgtaaccgggtaagtcggtacgggtcctaccgaaccctacgacttccgttcggtaccttacttcgttaccccg

SEQ ID NO: 4736 - DNA, 920 bp, Homo sapiens
  misc_feature: GYAE6OF02H4QIO.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagctccctggctgtcgtctctgggcgaggacgggccaccatccaactcgacaacgtccagaccagtaggttacgttttaacacacggtaccaaaacaaagtaaaggtaaactttaacgtttccgtacgttttacggaacctaagaccgaaacggaaaaaccgacgggaaccaacggtaccccttaacccgttaaaggttcgtacccttaacgttaaactttttaacccggcgggggaccttaacggttacccggttaaccccgggggtacgggtttacccccgggggtccctaacgggtaacccgtacgttaccgacgggaccggcgacggggtccgggttactacgggaacgaacgttaaggtactttttcccgaacctttcctacccgtaacctacgtaccacggaccgtaacggcccgttaggaccggaacgggtaccgttaaggaaacggtacggttacgggtacgggttaaccgttaaggtttttaacgttaaccgttacggtttacctaaacggttaccgttaaaggttttaatttaaacggtttaacggttttaaccggttacccgttaacccggtttaacggttaccggggtttttaaccggggggaacccgggggttaaaccgtaacgggtaacggttaacggtaaaaccgttaacccgggtaaaccgtaacggttcgggtaccggtaccgtaacggaaccctaaccggttacttaccgttaccgtttacccttcgttacccgttccccgtttaaccccgg

SEQ ID NO: 4737 - DNA, 862 bp, Homo sapiens
  misc_feature: GYAE6OF02IB7JI.39.31.C09.1.454.CMB.1.raw
tcagtcgcactagtcacgaccggtgctcgatttagacgtctcatcaaggaaggaagggcagcaagatggtgttgcagacccaggtcttcatttctctgttgctctgatctctggtgccgtacgggacatcgtgatcgacccagtctccagacctccctggctgtgtctcgtggcgagacgggccaccattccaactggacaacgtccagccagtagttacgttttacacgtacggtaaccaaactaaaacgtaaagtaactttaccgtttaccgtcgttttacggtaccgaacgtaccgaaacgaaaaacccgaacgggaactaaccggtacccccttaacccgttaaaaggtttcgaccttaccgttaaagtttttaccgtacgggtacttaaccgttacccggtaacccgggggtaccggttaccccgggggttaccccacgggtaacccgtacgttccgaacggtccggacgacgggtcggtaccgtaggacgtaaccaggttactttccctaacgtaccttaccgaaccctacttcgaacgaccgtacgtcccgtacgacgtacgcgtaggtaaagtagttacggtaggtaccgttagttttaaacgttacgttacggtacaacggtagttaaagttacgttaaattagggtttaaccgttaccgttaccgtaagggttttaacccgggtttaccgggggaaccccggggttaaactaacggtcgttaacgggtaaacgttaccggttaaaaccgttaaacggtaaccggttacggttacgggtccccgttaacggacccgttaaccgtacgttaccccggttttagtttaccctttacccgttaccctttacccccg

SEQ ID NO: 4738 - DNA, 907 bp, Homo sapiens
  misc_feature: GYAE6OF02JL7VM.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacagtcgtgatcgacccagtctccagacctcccgtggctgtcgtctcgtggggcgaggacgggcccaaccataccgtaacgtgacgtaacggtccacggaccaaggtacgtttacggttttaccacgtacggtaccctaaaacaaagttaaacggtaacttttaaccgtttcggtaccgtttacgggtaacccacggaaccgaaaccggtaaaaaccgacggggaacctaccgtaccccgttaaccggtttaaaggttccgtaccgttacctttaacggttttaacccggtcgggacctaacggtttacccccgggtaaccccgggggttacggggtttccccccgggggttaccctacggggtaacccggttaacggttccggaaccggggttacggggaccggtaccgggggttacccggggttacgtaacgggaacggtaaccgttacgtttaccgttttccgaccttacccgtacctaccgtaacgtccggaaccggtcgtacccgtaccggttcggaaccggtacggttacgtacggtaaacgttcggttcggtaacggtcgttaaacttttacgttacggtggtaaccgtacgtaccgttaagtttagttacggttacgttaccggttccgaaccgttcgggtttacgggttacccggggaccgggtaacacggacggttagtaacgtaccgtaagtaaccgtacgggtaggttccgtaagtcccgtaccgtaaccgttgttacccgttctacgttccgttaccccgttaccg

SEQ ID NO: 4739 - DNA, 809 bp, Homo sapiens
  misc_feature: GYAE6OF02GA7MZ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctggctgtgtctcgtgggcgagacgggccaccatcaactgacaagtccagccagtagttagttttacactacggtaccaaacgtaataaagtaactttaaccgttccgtaccgtttacggtaacccagaaccgtaacggaaaaacccagggaactaaccggtaccccttacccgtaaaggttcgtccttaccgtaatttttaccgtacgggtacctaagttaccccggtaacccgggggtacggttccccgggggttaccctagggaaccccgttaagtttaccggacggccggtaccgaggggtccgggtaccttagggacgtacgaacggtcttttaccgacttacctaccctaccgaacgttcgaacgccgaacgtccgtgaccgaggaccttaaggaacggtgttcggtacggtacttaaggtttacttacgtacgtcgtaagtactagttagttaacgtacgttaccgttacctacggtaacgtttaccgggtttccgggggaacccgggttaaaccaacgggttcgtagggtaacgtaacccgttaaccggaaaaccggttaacccggttggtaacccggtaccgttacggtaacccacctttaccgtcggttaccttttcccgttaccgtaccctttaccccgg

SEQ ID NO: 4740 - DNA, 791 bp, Homo sapiens
  misc_feature: GYAE6OF02GHNXB.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctcagactccctggctgtgtctactgggcgagagggccaccatcaactgacaagtccagccagagttgtttaacacgacggtaccaaacaataaagtaattacttcgacttaggtaccagacagaaaccaggacagacctacctaagttcgctactatttaacgtggactattaccgtacccggggtacggtccggggtccctagaccgtacttacgacgcggacgacggccgggtacgtggaacgactacgtacttttacacgttacctaccgtaacccaattaccgaacgtaccgtaacggtcccgtttaggacccgtaacgggtacccgtaaggttaaaaggtaagtttacgggtacgggtaacttaacggtttttaaacgtttaccggttaggtacccgttaaacggtacgtaaacgttttaaacgtttaagttaaacggttaccggttaacccttacggttaaaggtttaacccggtttttacggggggaccccgggggtaaaacctaaccggttaccggtaacgggtaaacgaccttaaacggtaaaaccgttaaccggttagttacgggtacccgttaacgggacctaaccgttaacttccggttaaacgttttcccgttacgtaacttttacccccgg

SEQ ID NO: 4741 - DNA, 819 bp, Homo sapiens
  misc_feature: GYAE6OF02H8704.39.31.C09.1.454.CMB.1.raw
  modified_base (95)..(95): a, c, t, g, unknown or other
  misc_feature (95)..(95): n is a, c, g, or t
  modified_base (132)..(132): a, c, t, g, unknown or other
  misc_feature (132)..(132): n is a, c, g, or t
  modified_base (164)..(164): a, c, t, g, unknown or other
  misc_feature (164)..(164): n is a, c, g, or t
  modified_base (349)..(349): a, c, t, g, unknown or other
  misc_feature (349)..(349): n is a, c, g, or t
  modified_base (456)..(456): a, c, t, g, unknown or other
  misc_feature (456)..(456): n is a, c, g, or t
tcagtcgcactagtcacgaccggtgctcgatttagacgtctcatcaaggaaggaagggcagcaagatggtgttgcagacccaggtcttcatttcnctgttgctctggatctctggtgcctacgggacatcgngatggacccagtctacagactccctggctgtntctgtcgggcgaggacggccaccagtacaactgacacgtcagaccaggtagttacgttttaaccacgtacggttaccaaaacgtaaacttaaagtaactttaaccgttaccggtacgtttaacggtaccaacgtacgaaacgtaaaaccgagggtaaccacggtaccccttacgttaacggttcnccttaacttatttaccgtagggactacgtaccggtaacccgggtcggttaccccgggtcctcgtaccgtatcgtacggccgtacgacggtcggtcaggtacgaacgngttacttcacgtcctaccacttactcgacgtacgtaccgtacctggaccgtacggtacgtacgtaacgtaacggttggtaacggttaccgttaagttttaacgttaccggttacggttacgtacggttaccttaagttaacttaacggtttaaccggttaccgttacccgttaacgttaccgttttaaccggggtttacccgggggtaaccggggttaaccgtaaacggtacggttaacgggaacgttaaaccgttaaccggtaaaaccggttcggttacgggttacgggaccttttaaccggacccgttaccgttaacgtttccggttaacgttccgtttaacccgtaccgtttacccccgg

SEQ ID NO: 4742 - DNA, 873 bp, Homo sapiens
  misc_feature: GYAE6OF02JVXVH.39.31.C09.1.454.CMB.1.raw
tcagtcgcactagtcacgaccggtgctcgatttagacgtctcatcaaggaaggaaggggcagcaagatggtgttgcagacccaggtcttcattctctgttgctctggatctctggtcgccgtacgggacatcgtgatcgacccagtctccagcctcccgtggtctgtgtctcgtgggcgaggacggcccacctatacaacgtgacctaacgtccacgccgagtagttacgtttacacgaggtacccaaactaataaagtaactttacgttcgtacgttacggtaacctagacctaacgaaaccgaggtaccacgtaccccttacgtaagttcgccttacgtaacgtttacggcgggacctacgtaccccggtaaccccggggtacggttacccccggggtaccctaccgggtaacccgtacgtttaccggaaccggtccggtaccggagggtcccggggtctaacggaacgtaaccgtagttaacgtttcccaacttcccgtaactaccgtacgtaccggtaaggccgtaacgtcccgagtacccggtaaggtaccgtaggtaaagtcggttacgggttccggtaacgtttaacggttttacctaccgggttagtaccggtaacggttacgttaaacgtttactttaacggtttaaccgggttaccttaacccgggttccgtaaacggggttttaccggggtttaacccccggggggaacccggggttaacctaaccggggtccgtaaaggggttaccttaaccggttaacggtaaaaccgttccggggttaacggtacgtaaccccgtaggttaaccctaacccgttacgggttaaccctttcgttaccgttaacctcccggtttaccccgg

SEQ ID NO: 4743 - DNA, 801 bp, Homo sapiens
  misc_feature: GYAE6OF02JRRO6.39.31.C09.1.454.CMB.1.raw
  modified_base (486)..(486): a, c, t, g, unknown or other
  misc_feature (486)..(486): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacactcgtgatcggaccctagtccgtccaagtcctcccgtggtctggtgtctcggtggggacgaaggacggacccaccgactacaacgtgacgtaacgtcccgacgccgtagtagtttcgtttaaccgaacgacggtaccaaacgtaataacgttaaccttacgtccgtacgttacggtaacccgaggacaacgtaacccgaggaccacgtcctccgtaagttcgctacttagtttaccggcggtactaccggttacccggtaacccggggtaccggtttcccccgggggtcctaacgggtacccgtacgttacgtacggccgggtacgtcgggtaccggtactacggaaggtaacncgttagttaccaccgtcctcaccgactcgacgtccgagtccgtcgacctacgggtactaaggtaacggtcgttaggtaagttaacgttacgtttacgtacgttcgtaacgacgtagttaagttacgttaacgtcgtttaccgtaccgttacgtttaaacggggtttcggttacccgggggtaccgggtaacgaaccggttaggttacggaaggttacccgtaaacgtaaccgggtgttacgggtacgtcccggtaacctaccggtaacttccgtttaccggttaccggttacctttaccgcccgtttaaccccgg

SEQ ID NO: 4744 - DNA, 569 bp, Homo sapiens
  misc_feature: GYAE6OF02FPNF8.39.31.C09.1.454.CMB.1.raw
  modified_base (316)..(316): a, c, t, g, unknown or other
  misc_feature (316)..(316): n is a, c, g, or t
  modified_base (375)..(375): a, c, t, g, unknown or other
  misc_feature (375)..(375): n is a, c, g, or t
  modified_base (391)..(391): a, c, t, g, unknown or other
  misc_feature (391)..(391): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaaactgacaagtccagccagagtgttttacacaggtccaaacaaataaacgaattactcgtcttggtaccagcaagaaaccaggacagcctactaagttgctctattactggcagtctacccggggngtcccgggtcctgaccgtattcaggcggcgacggcggtctgagacagtatttcgactcncgacatcgagcagtcngctaggctagagagtgtaggtctaagtttatacgtcgtgacgtctagtattaatagtagtaccttacgtacgttacgtttcgggacccgggtacaaggcgtacgggagtactacgtaacggtaacgtaggtaccggtcgtacgtcaccgtacgttccgtgtccttactacgttacccg

SEQ ID NO: 4745 - DNA, 858 bp, Homo sapiens
  misc_feature: GYAE6OF02GPHCF.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtcctccagacctccctggctgtgtctcgtgggcgaggacggcccacatcgaactgacaacgtccacgaccgaggtagttacgttttaaccaactacggtaccaaactaataaagtaactttacttcgtcgtagtaccagacgaacgaaaccgacggaccacgacccttaccgtaagtcgtaccttacttacgtttaacgtcgggacctacgtccccggtaacccggggtccgggttacccgggggttcccctacggaacccggttattaccggacgggccgggtaccggacgggtccggttacggtaggacgtacgtaacgttactttacccgtaccgttccctacccgtaaccttaacgtacgaacgtcccgtaacggtccccgtggaccgacggtacgttaggaaacggtcgttaggtacggttactttaagggtttaccttccggttagtacggtaacttgtaaaacgttttagtaacgtttacggttaaccgttccgtttaaaccgggtttcggtttaaccggggttttaccgggggaaccccgggggttaaggaacccgggttaggttaaccggaagttaaaccccggttaaccgttaaaaccggggtccggttaacggggtacgtacccggttacccgtaacccgtaccgttaacgtttccccggttacggttttacccctttaccgacccccgtttttcccccgg

SEQ ID NO: 4746 - DNA, 660 bp, Homo sapiens
  misc_feature: GYAE6OF02GFQE8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacggccacatcaactgcaagtccagccagagttcgttttacacgtaggtaccaaacaattaagtaattaccgttcgtacttggtaaccagacaacgaaaaccaggaacacgaccctacctaagttgtcctctatttaacgtcgggctagtccgtacccgggacggtacccgggtccctcggacccgtattccgagcggtcgacggtccggtctagacgacgtatactttcacttcacgaactagtacagtccagcctgacgacgtcgtacgaagtagtggtacgtccgtagtttacttactgtctagacgttagtactttaagtacgttattcccgttacgtacgtttacggtttacggggaccggggtaacctagtaccggtaggtacgtaacgtaacgaaccggtaacgtaccggtaggaccgttagtacccgtaacgttcgttacgtaccgtttcctttaccgtaccgttttacccccg

SEQ ID NO: 4747 - DNA, 834 bp, Homo sapiens
  misc_feature: GYAE6OF02FU5A1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcctggctgtgtctctgggcgagagggccaccatcaacgtgcaagtccagccagtacgttgtttacacaggtaccaacaataagattaccttcgtcgttaggtaaccagaccaagaaaccagggaacctacgacccttaccgttaaggttcgtccttacgtaactttttacccggaggggacctaaccggttaccggtaaccccgggggtacggttaccccggggggttcccctacggggtaaacccggtactttccgaacgggtacccgggacgtaaccggtcggggggtctacgggaacggtaaccgaacggtaaccggtttacccacgtttccctaaccgtaacccgtaacgtacccgtaacggtaccgtaaccggtccccggttaggacccgaacggggtacccttaagggaaaacggtacgttacggggttacgggtaacgtttaacggttttaacgtttacgttacgttacgaacgtaagttacgttttaaattaggttaacccgttacgtacccgttaaccgtaaccggttttagggtttaaccgggggtaccccgggtaacgtaaccggtaggtttaccggaagtacgttaaaccgaaccgggtaacgtcggtacgggtacgttaccgacccgttactacgttacttaccgtttccttactacccgttccccg

SEQ ID NO: 4748 - DNA, 662 bp, Homo sapiens
  misc_feature: GYAE6OF02F1CX2.39.31.C09.1.454.CMB.1.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgctagacccaggtcttcatttctctgttgctctggatctctggtgcctacggggacatcgtgatgacccagtctccagacctccctggctgtgtctcgtgggcgagagggccaccataccaactgcaagtccagccgagtagttgttttacactaggtaccaacaactaagaattacttcgcttaggtaccagcagaaccgagacagcctactaagtnctcatttcgtggcatcgtacccggaggtcccgggtcctcgaccgattcgaggcggcacgggtcgggtcttacggaggtaaccgaggttactttaccgtacttccgtaaccgaacctatacccgtagccgtaccgaccctgacccgaggtaccgttaggaaagtattggtcggtacgtttaagttttacgtttacgtacgtccggtactacgtagtttaagtttagttaagttccgttacccttacgtaacggttacggtttcgggacccggggtaactacggtcgtacggagtacgtaacgtaaaccgtaggttcggtcgtcgtacgtaccgaaccgttacgtcgttcttaccgtaccttaccttacccg

SEQ ID NO: 4749 - DNA, 759 bp, Homo sapiens
  misc_feature: GYAE6OF02HRLA8.39.31.C09.1.454.CMB.1.raw
  modified_base (109)..(109): a, c, t, g, unknown or other
  misc_feature (109)..(109): n is a, c, g, or t
  modified_base (332)..(332): a, c, t, g, unknown or other
  misc_feature (332)..(332): n is a, c, g, or t
tcagtcgcactagtcacgaccggtgctcgatttagacgtctcatcaaggaaggaaggggcagcaagatggtgttgcagacccaggtcttcatttctctgttgctctggntctctggtgccgtacggggacatcgtgatgacccagtctccagactcccgtggctgtgtctctgggcgagagggccacactacactgcaacgtccagccagtagttgtttaacacgtacggtaccaaactaataagaactttacgttcgactttcggaccaggaccaaggaaaccagggaccacgtaccccttacgttaacgttcgcctactattttaccggngggtacctacgttaccggtacccggggtacggtccccggggttaccccaggtaacccgtattccgagggccggcgaacggtccggggtactgggacgaactaacggttacttttacccacgttacctacaaacccctagtacctacggctaaccggtcccgtacggaccgtacgggtacgtaggaaacgtaaggttcggtaggtacgtttaagttttaacttacgttacgtaccgtagacgtaagttactttaacgttaggttaacgttaccgttacgtacggttacgggttttaccggggacccggggtaaccgtaggacgttaggaacgtaccgttaacggtaaacggtacgttacggtacggtacgttaccgacccgtaacgtacgttaccggttccgtttaccgttactacccgtttaccccg

SEQ ID NO: 4750 - DNA, 846 bp, Homo sapiens
  misc_feature: GYAE6OF02G0PJ8.39.31.C09.1.454.CMB.1.raw
  modified_base (322)..(322): a, c, t, g, unknown or other
  misc_feature (322)..(322): n is a, c, g, or t
tcagtcgcactagtcacgaccggtgctcgatttagacgtctcatcaaggaaggaaggggcagcaagatggtgttgcagacccaggtcttcatttctctgttgactctggatctcgtggtgccgtacggggacatcgtgatcgacccagtctccagaccttccccgtggctgtgtcgtcgtgggcgaggacggccaccatcaactgcaagtccacgccagtagttcgtttacactaggtaccaaacaagtaagtaacttaccttcgtacttacggaccagacacgaaaaccaggacacgcctactagtcgctcttacttacgnggctacgttacccggtacccgggtacggtccccggggtcctacggaccgtacttaccggcgggccggacgacgggtaccgggtctacgggaacgtacgtagttacgttttccaccttaccgtaccaaccgtacgtaccgaacggtacaccggttccctacgggaccgtacggacgttaaggaacggttcgtttagggacggtttaacgttttaaccggttttacttaggttaaccgtaacgtagttacccggttaaagtttaacgtttaacgttaacggttaacgttcctaaacgttcggttttaaccgggtttaaccgggttttacccgggggggtaaaccccggggtaaataacccgggggttaacgttacggggaacccttaaccgggttaaacccggttaaaaaccggtttaccggggtacgggtttaacggtaccccggtttaacggaaccccccggtttaaacgttttccgttaccccgggttttttagtttacccccgtttaaaccgttcccccccg

SEQ ID NO: 4751 - DNA, 825 bp, Homo sapiens
  misc_feature: GYAE6OF02IE3L4.39.31.C09.1.454.CMB.1.raw
  modified_base (313)..(313): a, c, t, g, unknown or other
  misc_feature (313)..(313): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatgacccagtctccagacctccctggctgtgtctcgtgggcgaggacggccaccatcaactgacacgtccacgcctagtaggtttcgtttaacacgtacggtaccaaactaaagttaaacggtaactttacgttaccgtcgtttacggtaccaggcaaacggaaaaccacgggaaccnccggtacccttaccgttaagttcgtccgtaacttacgtttacggtacggggacctaccggttacccggtaccccgggggtacggttcccccggggtaccctacggtaccggtacttaccgacggtacccgggtccgtaagggtcccggggtcgtacggtaccgacggtaacgtacttttacccgaccgtacccgttaccgtaaacctacgtacgaaccgtcggtacccgtacgtacgaccggtaagggtccgtaaggaaggttcgttagggtaccggtaacttttaacgttttaccgttaaaccggttcgttaaccgtaggacgtttaacgttactttaagggtacggttaaacccttccggtaaccgttacggggtttaccggggtttacccggggaacccggggttaactaaaccgggcttaaggggtacctaacgtaaccggtaacgtacggtacggtcgtacgtacgtccacggtacttccggttcgtaccttccgtaaccttccccg

SEQ ID NO: 4752 - DNA, 760 bp, Homo sapiens
  misc_feature: GYAE6OF02HZ24Z.39.31.C09.1.454.CMB.1.raw
  modified_base (149)..(149): a, c, t, g, unknown or other
  misc_feature (149)..(149): n is a, c, g, or t
  modified_base (162)..(162): a, c, t, g, unknown or other
  misc_feature (162)..(162): n is a, c, g, or t
  modified_base (177)..(177): a, c, t, g, unknown or other
  misc_feature (177)..(177): n is a, c, g, or t
  modified_base (194)..(194): a, c, t, g, unknown or other
  misc_feature (194)..(194): n is a, c, g, or t
  modified_base (560)..(560): a, c, t, g, unknown or other
  misc_feature (560)..(560): n is a, c, g, or t
tcagtcgcactagtcacgaccggtgctcgatttagacgtctcatcaaggaaggaagggcagcaagatggtgttgcagacccaggtcttcatttctctgttgcttctgatctcgtggtgccgtacgggacatcgtgatcgacctagtccnccgagacctcccnggcttagtgtctcgngggcgagcggtccaccntacaacgtgacagtccagccgtagtggttcgtttaacacgacgtaccaaacaaagtagttaactacttcgcttacggtacctagacaacgaactagacacgtcctacgtaagtcgtacttctacgttcgtggacctcgtaaccggtcccgggtacggtaccccgggtccctacggtaccgttacgtacggtcggaccggttacgacgggtaccgggtctacggtaacgtaaccgagtttaccgtttacgtcgtacctaaccgactaacgtacgacgccgtcgtaccgtagaccggtacggtctaaacgggtaataacgttcggcggttaactttacggtttaaccgttccgttaacggtacgttanaacccgggtttaaattacgtacggttagtacccgttaaccgttaggttacgtttaacccggggttccgggaacccggttaacggtaacggcgttaacggaaacgttacgtaaaccgaacgggttaacggttcggtaagccccggtaaagtaccctaacggttaccttcccggacgttttaccttaccggtaacgttcccc

SEQ ID NO: 4753 - DNA, 720 bp, Homo sapiens
  misc_feature: GYAE6OF02H7LXP.39.31.C09.1.454.CMB.1.raw
  modified_base (667)..(667): a, c, t, g, unknown or other
  misc_feature (667)..(667): n is a, c, g, or t
tcagtcgcactagtcacgaccggtgctcgatttagacgtctcatcaaggaaggaaggggcagcaagatggtgttgcagacccaggtcttcatttctctgttgctctgatctctggtcgccgtacgggacatcgtgatcgacccagtcctccacgacctcccgtggctgtcgtctcgtggcgagacggccacatacgaactcgacaacgtccacgcgagtagttcgtttaacagacgtacaacaataagtacttactcgattcggtaccagacaacgaaccaggacctcgacctacgtaagtcgtactagtactttacgcggtactaccgtaccgtcccgggtacgggttccccggtaccgtacggtaccgtattacccggagggacccggtggaacgggttccgggtactaacgggaacggtaacagttaccgtttacaccttacgtaccaacaacgtcaggtaccacgccgtcgagaccggtactagtaacgtaggtacgttagtacttagtttactacgttactacggaccgtaagttaactgttaaaacttgttaaccttaccggagttacggttaccggttacgggacccggggtaactaacggtagggtaccggtaagtccgtaaaacggtacccgtaaggttcgggtaccgtacgttaccncggttaacccttaccgtttcgtaaccgtttccgttacttacccgtttaccccg

SEQ ID NO: 4754 - DNA, 795 bp, Homo sapiens
  misc_feature: GYAE6OF02HBRBN.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtcctcgtgggcgaggacggcccacataccaactgacaacgtccacgccagtagttcgtttacactacggtaccaaacaataaagtaacttacttcgtcgttacgtaccgagacaacgaaaccgaggaccacgaccctaccgttaagtgactacgttacgtttacgtacggactacgttacccggtaacccgggtacgggttcccccggggtaccctacggtaaccgtagttccgacggtcggaccgacgggtccggtcgtaggaacgacgtagtctttaccacctcctaccaacctacgtcaacgccacgtccgaggccgaagggtacaagggaagttagtcgggtagtaacgtttagtttaaaccgtcggttaacgtccgtaaacgtacggtttaattaacggtttacgttaacggttaccgttacccggtacgtttaaccgggttttaacccggggttacccggggaaccggggtaacccttaaacggggtcgtaacggggaacttaccgggtaaaaccggtaaaccggttacggttacggggtcccgtaaccggtacccggtaacttaaccccggttcggttttacccgttacgtttcccgtttaccgttaccccgtttccccgg

SEQ ID NO: 4755 - DNA, 714 bp, Homo sapiens
  misc_feature: GYAE6OF02JP5R8.39.31.C09.1.454.CMB.1.raw
  modified_base (167)..(167): a, c, t, g, unknown or other
  misc_feature (167)..(167): n is a, c, g, or t
  modified_base (220)..(220): a, c, t, g, unknown or other
  misc_feature (220)..(220): n is a, c, g, or t
  modified_base (536)..(536): a, c, t, g, unknown or other
  misc_feature (536)..(536): n is a, c, g, or t
  modified_base (701)..(701): a, c, t, g, unknown or other
  misc_feature (701)..(701): n is a, c, g, or t
tcagtcgcactagtcacgaccggtgctcgatttagacgtctcatcaaggaaggaagggcagcaagatggtgttgcagacccaggtcttcatttctctgttgctcgtggatctcgtggtcgaccggtacgggacacttcgtgagtcgaccgagtctacacgacctccnggtctcgtcgtctcgtggacgagcggtccactcgtacactgactaacgcgacncagtgttcgtttacagacgtacaacgtaataacgtcttacttcgcttaggtaccagactaacgaaaccgaggtacaccgtccttacgtaacggtctacctacgtactttacggcggactaacgttcccggaccggggttacgggtccccgggtccgtaaggtacacgttcgaaccggcgacgtacggtcggtactaggaacgtcgtaacttactttcgaccgttcctaacgtactacggactacggacgtaccggcctagggacctaacggtacgtaacgtaacggtacgttaacggcttacggtagtttacgttnacggtacgtaccaagttacgttaatacgtaccgtactcgtaaccgtgggttaccggtttacgggaaccgtacaacggtacgacggtataaccggaacttaaccggacgtttcggaacggcgttaccgaaaccgttcgtacgttcggttaacccttcggttaaccnccgggtttaaccc

SEQ ID NO: 4756 - DNA, 710 bp, Homo sapiens
  misc_feature: GYAE6OF02FNLUA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccacgacctcccgtggcctgtgtcctcgtgggcgaggacgggcccaccatcaactgacaacgtccacgaccaggtagttacgtttaacaccgtaacggtaccaaactaaataaacggtaatttaccgttcgtccgttacggtaacccaggaccgaacgaaaccgaggacacgtccctaccgttaaggttcgcttacgtacgttacgtcgggactacgttacccggtacccggggacggttccccggggttcctacggaccgtgtaccgacggccggacgtacggccggtcgtaggacgactacggtactttaccactcctacactactcgacgcacgtccgtacggacgtgtacgagtacgtacgttcggacggttacttacggttattaccgtgactacgtacgtattagttacgtcgtaccgtacgttcaacgggtttacggttaccggggacccgggtaacagggttacgtacgggaacttacgaaccgtaacggtcggttcgacggtaccgtagaccctaacgtcgttacgttaaccgtcgttacctaggtcccccg

SEQ ID NO: 4757 - DNA, 760 bp, Homo sapiens
  misc_feature: GYAE6OF02F99MQ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagagttgtttacacaggtccaacaataaagaattacttcgcttggtaccagacaagaaaccaggacagcctactaagttgctctatttacgtgggcacgtccgtaacccgggaggttccccggggtaccctcggaaccgacttcgacgggccggcgacggtcggggtactaggacggtacaggttactttaccgaccgttcgtaccaaccgtaacttaccgaggccctaacggtcccggttcggacccgtaacgggaccttaacgggtaaagtacggttaggtacggtaccgttaaggtttttaacgttaccgttaggttaccgtaacggtaccttaaggtttaaactttaacgttaacggtttaacgttacccgttaccgtaaacggttttaccgggtttttacgggggaaccccgggggtaaccgtaaacggttccggtaacggggtaacggtaacgttaaccggtaaacgggtaacggttcggtacgggtaccgttacggaccgttaaccgtacgttaccgttcgtttaccttaccgtaacctttccccgg

SEQ ID NO: 4758 - DNA, 1042 bp, Homo sapiens
  misc_feature: GYAE6OF02G2E49.39.31.C09.1.454.CMB.1.raw
  modified_base (996)..(996): a, c, t, g, unknown or other
  misc_feature (996)..(996): n is a, c, g, or t
tcagtcgcactagtcacgaccggtgctcgatttagacgtctcatcaaggaaggaaggggcagcaagatggtgttgcagacccaggtcttcatttctctgttgctcgtgatctctggtgcctacgggactatcgtgatacgaccctagtcctccacgaccttcccgtggtcgttagtgtcctcggtagggaccggacggtacgggacccaaccgtactaccgtaaccgttaggtaccgtaaacggtacccgacggacccggtaacggtaacggtttacgttttaacccaaccggtaaccgggttaaccctaaaacgtaaacgttaaaacggttaaactttttaacccggttacccggttaccggtttaccggtaacccgtaacggtaaccgtaaaaccggaaaaccccggtaacgggtaaccctaccggtacccccgttaaccgtttaaacgttccggtacccgttaccttaacggttttaacccggcgggtaaccgttaccggttaaccccggggttaacccggggtacccggggttacccccggggttacccttaacgggtaacccgttaaccggttccggaaccgggtccgggtacggtacccgggttaccggggtaccgtacgggtaaaccggaccgtacgtttacccgtttacccggacctttaccgtaccgtaacccgtacgtaaccgtacggtcctacccgtcggttaccgccggtaaccggtacggtaaacggaacggttaccggttaggtaaccggtttctttaaacggtttaccgtttacggtacccggtaagttaccggttaagtttaacgtttaacgttacgttaaccggttaaccgtttacccgtaaccgggtttaacgttttaccgggggtttaaccccggggtaccgggtaaccgtacggtaacgggtaagttaaccgtaccgttaaaaccgtacgggttaaccgtacggttacggtaccttaacccggacttacccggttnttacccgggtttacctttggttaaccccgttacccgtttaaccccg

SEQ ID NO: 4759 - DNA, 801 bp, Homo sapiens
  misc_feature: GYAE6OF02GQSI1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagacctccctggctgtgtctcgtgggcgaggacggccacatcaactgacaacgtccagccgaagtagttcgttttaacacgtacggtaccaaactaaataaagtaactttacgttcgtacgtttacggtaaccagacaaacggaaaaccgtagggaaccacggtccctaccgttaagttcgtcctactacgtttacggcgggtactacgttaccggtaacccgggtacggtcccggggtaccctcggaaccgttcgttacgacggccggtacgacggtccgggtactaggaacgtacgtacgtacttttacgaccttaccgacctacctactccgacgtcgacgtcccgttaggacgtaggtaccgtaaggtaacggtagttgggtaccgtacgtttaacttttacggttacgtacgttacgtaacgggtaccgtttaagtttaactttaacggtacgtttaccgttaaccgttacgtaacgggtttttaccgggttacggggaaccccggggtaaacgttaaacggaccggttaaggtaacgtaaccgttaacgtaaaccgggtaagttccgggtaaccgtacgttaccgttaacctaaccggttacgttaccgtttacggtttaccttaccgtaccccttttacccgg

SEQ ID NO: 4760 - DNA, 935 bp, Homo sapiens
  misc_feature: GYAE6OF02HMKQ2.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagacctccctggctgtgtctcgtgggcgagacgggccaccatcaactggaccaaggtccaggcctaagagtttagttttaacgactaacggttaccaaacaaattaaagtaactttaacgttccgtcgttacggtaacccaggtaccaaacggaaaaacccgaggaacctacggaccccttaccgttaaaggttccgtaccttacgtaactttttaaccgcggggtacctaacgttacccgggttaaccccgggggtaacgggtttcccccggggggtacccttaccggtaacccggtactttaccgaacgggccggaaccggtacgggtccggttaccggtaggtaaccggtaacgttaacggtttaacttttaccccgaacctttacccgttaacccctaacctaaccgtttacccgaacggacccgtaaccggtttacccgtacggacccggtaacgggtaacccgtaagggtaaaacggttaggttaacggtaccgggttaaccgttttaaggttttaaccttaacgtttcggttaaccgtacggttaacgtaagtttaagtttaacgtttaacggttaaccgttaccccgttacggttaaccgggtttaccgggtttaccggggtaacccgggggttaaccgtaaccggtacggttaacgggtaacgtaaccggttaaccgaaaaacgggttccggttaacggtaccggtaaccggtttaccgaaccgttaacccggttacgttaccggtttaaccgttcctttacttacccggtttccccg

SEQ ID NO: 4761 - DNA, 805 bp, Homo sapiens
  misc_feature: GYAE6OF02HLCKR.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcccgtacggggacatcgtagatacgaccctagtcctaccacgacccttcccctggcctggtgttcctcgtgggcggaaggacggcccaacacgtacaactgacaacgtccacgccgagtagttcgtttaacactacggtaccaaactaaagtaacgtaattaccttcgtcttacggtaaccagacaacggaaaccgacggacctacgtacccgttaccgttaagtcgtaccttacgtaacgtttacggcgggtacctacgttaccccgggtaaccccggggtaccgggttcccccgggggttaccctccggtaacccgtagttaccgacggtccggaacggtacgggcggttacgaacggtaacgaacgtaacggttactttaccgtaccttaccgtaccctaacctacctaccggacgtacgtaccgtccgtcgacggtacgtagttacggaagttacgtacggtcgggttaactttaacgttttacgtaaccgttacgtaaccgaggttaaccgttaatttaaaccgtttaagtacgttacgtaccgttacggtacgttttaccgggtacggggaacccgggtaactaacggtggttaacggagtaacgaaccggttaagtaaccggtggtacgacgtaccgacgttaaccgtcttaccgtcgtttacccgtctaccgttacccc

SEQ ID NO: 4762 - DNA, 659 bp, Homo sapiens
  misc_feature: GYAE6OF02JV538.39.31.C09.1.454.CMB.1.raw
  modified_base (222)..(222): a, c, t, g, unknown or other
  misc_feature (222)..(222): n is a, c, g, or t
  modified_base (305)..(305): a, c, t, g, unknown or other
  misc_feature (305)..(305): n is a, c, g, or t
  modified_base (607)..(607): a, c, t, g, unknown or other
  misc_feature (607)..(607): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggagggcccaccatcaactgcacgtccagccagagttgtttacncaggtccaacaataagaattacttcgcttcggaccagcaacgaaccaggacacgccttaccgtaagtcgtctctactttacgnggtcacgtcgtaccgggacggtccgggtcccacgtaccgattcgaggccggacgacggtcgggtacttagaaggtacagttacgtttccaccgttacctcaacctactaccgaacgaccgtacgtccgtacgtaccgaccgggtacgtaggaaggtaccgtagggtacggtaccgtttaactttagttaacgttgaccgtagtaccgtagttacttaagttacgttacgttaccttacgtacgttacgggtttccgggtaaccgggacgtaacgcgttacgaagtacgtacgtaaaccggtntaacggtcgacgtcgacctacgtactcgttccgtacttacgtcttaccccgg

SEQ ID NO: 4763 - DNA, 675 bp, Homo sapiens
  misc_feature: GYAE6OF02H4SCD.39.31.C09.1.454.CMB.1.raw
  modified_base (166)..(166): a, c, t, g, unknown or other
  misc_feature (166)..(166): n is a, c, g, or t
  modified_base (443)..(443): a, c, t, g, unknown or other
  misc_feature (443)..(443): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgaccagtctccagactccctggctgtntctcgtgggcagcggaccacatcaactgacaacgtccagccagtagttcgtttaaccgacacggtaccaaactaaataagtaactttacttcgtcgttcggtaaccagaccgaacgaaacctaggaaccagtcccttaccgttaagtcgctactatttacgtggctacgtccgtacccggggtggtccccgggtccccacgtcgttcgaggaccgacgacggtcgggtactacggacgtacgtagtatttaccacttaccgacctcgtaactcggancccgtacgtcccgtacgacgacgttacgaagggactagggtacgttcgggaacttacgtttactacgtcgacgtacgctagttacgttagtaccttagtactacgtacgtttacgggtttcgggcccggggtactagaccgtaaggtagactaaccggaaccgtacgtggtacccgtacgtccgtaacgtaccgagtttcgtccgttacctttaccgtcttaccgttccccg

SEQ ID NO: 4764 - DNA, 870 bp, Homo sapiens
  misc_feature: GYAE6OF02G7IBW.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgaccctagtcctccaagtacctcccgtggactggtcgtctcggtgggcggaggacgggacccaccatacaactgaccaacgtccagccaggtagttcgtttacacgtacggaccaaacaaagtaagtaacttacgttcgtcttacggtaccagtaccgaaacgaaaccgtagggaacctacgtacccttacgtaaggttcgccttacgttacgttttacggcggtaactaccggttacccggtaacccgggggtacggttcccccggggttaccctacggtaaccggttacgttaccgagggtcccggggaacgccggggtacgggttctacgggaagaacccgttaggttaacctttcccgtaaaccttcccgtaaccgaaccctacgtaccgtaacggtccctaacggtccccgtagggaccgtacgggtaccgttaagggaaacttaggtcgggttaacggttacttttaaacggttttaaccgttacggttccggtttaacggaccgtaacggtttaacgttaaagtttaacggttaacgttaccggtttacccgtaggttacccgggtttttaacgggggttacccggggaacccggggtaaccttaagggtaccgggttacggaaacgtaccgttaaaaccggtaccggtaggttaccgggtgtaaccccgtagtacccgtaacttcgggttaccgtcgtttaacccgttcgacccgtttacccc

SEQ ID NO: 4765 - DNA, 595 bp, Homo sapiens
  misc_feature: GYAE6OF02GZN6S.39.31.C09.1.454.CMB.1.raw
  modified_base (335)..(335): a, c, t, g, unknown or other
  misc_feature (335)..(335): n is a, c, g, or t
  modified_base (388)..(388): a, c, t, g, unknown or other
  misc_feature (388)..(388): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttacacaggtccaacaataagaattacttcgcttggtaccaggcagaaaccaggacagcctcctaagttcgctcatttactgggctatctacccgggagtccggggtccctggacccgattcnggtcggccaggcgggtctgagtacagatttcactctcaccgtatcacgtcacncctagccagggctagaacgatcggtagctagttttacgtacctggtcccaagtccgtattattaacgtagtaaggttccccattagtaccgttttacggggccggggaaaccgtagtaccttggggactacgttcgaaacgtaaccggtggtacgggaccttggaacctacccgtaattccgttggtacctttacggactttccccg

SEQ ID NO: 4766 - DNA, 754 bp, Homo sapiens
  misc_feature: GYAE6OF02IUBJ0.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgaccagtctccagacctccctggctgtgtctcgtgggcgaggacggccaaccatcaactgccaatccgagcagagttgtttaaccactacggtaccaaacaaagtaaacgtaattaccgttacgacgtttcgggtaaccaggacctaaacgaaaaccgacggaacaaccgtaccgtaccgttaaacgttcgacccctaagttttaaccgtcggggactaaccggttccggtacccggggtaacgggttccccgggggtaccccttacggtaaccgtacgttaccgaacggtccgggacgacggtccgggtacctaggtacgtactaggtacttttccgaactcctaccgtaacctagtaccacgcgtaaccgtccgtacgacggacggtacgtagggaaacgtaggttaggtcggtacgttaagtttaacgttacgttagtacgtacgtacttaagttacttaagtaccgttcgtacgttactaacggttcggtttacgggacccggggttaacgacggtaacggtaggaacgtagtaccgtaaacggacgttaacggtcggtacgtacggaccttaccgacgttctacggtctttaccgtctacgttacccccg

SEQ ID NO: 4767 - DNA, 761 bp, Homo sapiens
  misc_feature: GYAE6OF02FP254.39.31.C09.1.454.CMB.1.raw
  modified_base (180)..(180): a, c, t, g, unknown or other
  misc_feature (180)..(180): n is a, c, g, or t
  modified_base (338)..(338): a, c, t, g, unknown or other
  misc_feature (338)..(338): n is a, c, g, or t
  modified_base (686)..(686): a, c, t, g, unknown or other
  misc_feature (686)..(686): n is a, c, g, or t
  modified_base (704)..(704): a, c, t, g, unknown or other
  misc_feature (704)..(704): n is a, c, g, or t
  modified_base (713)..(713): a, c, t, g, unknown or other
  misc_feature (713)..(713): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcccgtacggggacatcgtgatgacccagtctccagacctcctggctgtgtctcgtgggcagnggccaccatcactgacaagtccagccagtagtttcgtttacacgtacggtaccaactaagttaagtaatttaccgttcgacttttcggaaccagaccaagaaaccgtacggacaacgtccccgttacgtaaggttcgtcttacgtagtttttaccggnggtcctacgttaccccggtacccggggtacgggttccccggggggttcccctaccggaaccgttacgttaccggacggggtccggaccgtacggggttccgggtacgttacggacgtaccgtagttacctttacccgtaaccgtttctaacccgtacccaaacgttcaaaccggtccgtaacgtccgcgacgtacggagttacgaaaggtcgtggttacgtcgtaacgttttacttacggttactacgtacgttagttaagttaacgttttacgtaaccggttacgttccgtaacggtttacggttaacggtttccgggggaaaccggtacgtaacggcgtttaaggntacgtaccgaacgttggnttaccggtntacccgtcgaccttacgttccggtactttcccggacttccctaccccg

SEQ ID NO: 4768 - DNA, 734 bp, Homo sapiens
  misc_feature: GYAE6OF02GXNA2.39.31.C09.1.454.CMB.1.raw
  modified_base (70)..(70): a, c, t, g, unknown or other
  misc_feature (70)..(70): n is a, c, g, or t
  modified_base (577)..(577): a, c, t, g, unknown or other
  misc_feature (577)..(577): n is a, c, g, or t
  modified_base (702)..(702): a, c, t, g, unknown or other
  misc_feature (702)..(702): n is a, c, g, or t
tcagtcgcactagtcacgaccggtgctcgatttagacgtctcatcaaggaaggaagggcagcaagatggngttgcagacccaggtcttcatttctcgtgttgctcgtggatctcgtggtcgccgtacggggacatcgtagactagacccagtcctccagacctccctggacctggtcgtactcgttcgggacgtaggacgggacccactacgtacctaaacgtcggtacctaaacggtcccaaggtccaagggttaagttttacggtttttaaccaaccggttaacgggtaaccccaaaacgtaaagttaaacggttaaactttaccttcggttacggtttaccggtaaccgtaggaccaaacgaaacccgacgggaacacggtaccttaacttagttacgtctactacgtttacgacgggtactacgtaccgtaacccgggtacggtcccgggtaccctagtaccgtacgttcgaccggacggacggaggtccggtacttagacgtactagttacttacgacgtcgttaccaacctactacaacgtcgatcccgacgtgacggacgtaagacgtanacggtgtacttagttacttagcgttacgagtacttagtactttagtacgtactaccgtagtaccgttaggttaccgtaaccggactacgtagacggtatacgtaacgtacgacgtgtacacgtanacgtaccgcttagtcttaccgtgtacttcccg

SEQ ID NO: 4769 - DNA, 698 bp, Homo sapiens
  misc_feature: GYAE6OF02JZMJ4.39.31.C09.1.454.CMB.1.raw
  modified_base (188)..(188): a, c, t, g, unknown or other
  misc_feature (188)..(188): n is a, c, g, or t
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgacgggacatcgtgatcgaccacgtctccagcctcccgtggctgcgtctcgtggcgaggacggccacngtacatgacacgccagcagtacgttgtttaccacgacgtaccaaactaataattattaaccgttccgtcgtttaccggtaaccacgaaccgaacggaaaccgtacggacaccggttacctacccggttaattcgtacccgttacttaacgtttcggcgggactaccgtacccggtacccggggtaaccggttccccggggttacccgtacgtaacccgttacgttacgacggccgggtactcgggtacggttccgagacggaactgtacctgtacctcgactaacccntacncgctccncgacgcgacggacgtaagacgtgtcgtagtacgttagttacttacgtcgtcgtagtactacgttagttacgtacgttaccgtacgtacggtacggttaccggtaccgggtacggtacgacggttacggtacgtaaccgtaccgtaacgtaacggtgtccggtcgtccgtactacccgattaccgtcgtacgttaccgttccgttaccgtcc

SEQ ID NO: 4770 - DNA, 764 bp, Homo sapiens
  misc_feature: GYAE6OF02FZZ7N.39.31.C09.1.454.CMB.1.raw
  modified_base (350)..(350): a, c, t, g, unknown or other
  misc_feature (350)..(350): n is a, c, g, or t
  modified_base (746)..(746): a, c, t, g, unknown or other
  misc_feature (746)..(746): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctcccgtggctgtgtctcgtgggcgaggacgggcccaccgataccaactgacaacgtccagccaggtagttacgtttacgactacggtaccaaactaaagtaaagtaatttaccgtcgtcgttacggtaaccagacaaacggaaaccgaggaacacgtaccctaaccgtaaggttcgacttactaacgttttacggngggacctacgtacccggtaacccgggtacggtccccggggtacctcggaccgtacttcgacggccggacgacggtccggtctagaacgtacgtacgtacgtttacctaccgtcctaccgaacctacgtaccgaacgcccaaggtcccgtaggaccgtacgggtaacctaagggtaacgttacggtcgggtacggtaccgtttaaacgttttacgttaacgttcggttacgtaacggtacgtttaagtaagttttacggtacgtttacccggtaccgttcgtaacggttttaccggtttaccgggggaccgggtaaacctacgggtaccggtaggaacgttactaaccggaacgttaggttccggtaggtcctacggtaccaacgttcgtcgttacnctttaccgactttccccg

SEQ ID NO: 4771 - DNA, 796 bp, Homo sapiens
  misc_feature: GYAE6OF02HLSES.39.31.C09.1.454.CMB.1.raw
  modified_base (177)..(177): a, c, t, g, unknown or other
  misc_feature (177)..(177): n is a, c, g, or t
  modified_base (480)..(480): a, c, t, g, unknown or other
  misc_feature (480)..(480): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtgatacgacccagtctaccagacctccctggctgtgtctagngggcgaggcggccaccatacaactgaccaacgtccacgacgagtagtttacgtttaccaacgacggtaccaaactaagtaacgtaactttaccttcgtacttacggtaccagacaacgaaaccgaggaaccacgtaccctaccgttaagttcgtacctactatttacggtcggtactacgtcccggtaacccggggtacggttcccggggttaccccacggtaccgtagttacgacggccggaccgtacgggtcggtacgtacgacgacgtacgttactttaccgacctcgtaccaccttacncgtaaccgactacccggactacgaccggtaggtaacgtaggtaaacgtagttcgggtacggttacgtttaacgtttacttaccggtagttaccgaacgttaacgttaacgttttaaacgtttacgggttaccgttacggtttaccctaacgtttacccggggttttacgggttacccgggggtaacccggggtaacctacggtacgggttacgtaacggttaaccgtaaaccggtaaacggttaacggtgtaaccggtacgaccggtacttaccgtgtttccgttaaccctttcgttacccggtcgtttaaccccc

SEQ ID NO: 4772 - DNA, 692 bp, Homo sapiens
  misc_feature: GYAE6OF02HPE39.39.31.C09.1.454.CMB.1.raw
  modified_base (488)..(488): a, c, t, g, unknown or other
  misc_feature (488)..(488): n is a, c, g, or t
  modified_base (652)..(652): a, c, t, g, unknown or other
  misc_feature (652)..(652): n is a, c, g, or t
  modified_base (666)..(666): a, c, t, g, unknown or other
  misc_feature (666)..(666): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagactccctggctgtgtctcgtgggcgagaggccaccatcaactgacaacgtccagccaagtagttagttttacactacggtaccaaactaaataacgtaacttacttcggtactttacggtaccaagaccgaaacgaaaaccgaggaaccacggtccccttaaccttaagttcgccttactaacttttacgtcgggactacgtaccggtacccggggtaccgggttccccggggtcccgtcgtaacccgtattcgacggtccggacggtacggtccgggtcgtgaacgtacagttacttccgtactcctacgacctactcgacgctacgggtcccngaccgtggacaaggtagtagtcggtcgtactttacgttacgttattacgactacgtagttacgttattaacgttcgttaacttccgtagttacggtttccggttaccggggaccgggtacgtaacgtaggtacggagttacgaaccgtaacgtacgtaggcgtnaccgtctaacgttntccttagttacccttataccttcccg

SEQ ID NO: 4773 - DNA, 713 bp, Homo sapiens
  misc_feature: GYAE6OF02H4S8U.39.31.C09.1.454.CMB.1.raw
  modified_base (326)..(326): a, c, t, g, unknown or other
  misc_feature (326)..(326): n is a, c, g, or t
  modified_base (439)..(439): a, c, t, g, unknown or other
  misc_feature (439)..(439): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccagacctccctggctgtgtctcgtgggcgaggacggccaccgatccaactgacaacgtccacgccaagtagttcgtttaaccacgacggtaccaaacaaataaagtaactttacgttcgtacgttacggtaccaagacgaacgaaaaccgaggaaccacgtccttaacgtaagttcncctactatttacgtggactagtccgaccggagtccccgggtcctagacgtactcgacggccgacgacggtcggtctagggaactacgagtactttcaccttccgtacaactanccgtacgcgtacgtccgtgacggacggacgtaagaaacggtagttcggtacggtacgtttaagttttaacgttacctacggttactaacggtaccgttaagttaactttaagttacggttaacgtttaccgtacgtttaacggttacccgggttttcgggggaaccgggtaaccgtaacggtacgtaggaacgtacgttaaaccgaacggtacgtacggtagtaccgttacgaccgacgttcctacgttacccgtttctacgttccttaccccg

SEQ ID NO: 4774 - DNA, 827 bp, Homo sapiens
  misc_feature: GYAE6OF02JGGNW.39.31.C09.1.454.CMB.1.raw
  modified_base (782)..(782): a, c, t, g, unknown or other
  misc_feature (782)..(782): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctagggcgagacggccaccagtccaactgccacgtccagaccgtacgagttcgttttaccaaccgtaggtacccaacgtaataaacgtaactttacgttaccgtccgttacggttaaccgacggaaccaaccggaaaaccgacggaacctaacggtcccttaccgttaaaggttccgtacgttacttaacgttttaaccgtcggaacgtacgttaccggtaaccccgggtcgttacccccggggttaccttaccggtaaccggtctaccacggtccggtacgcgggtaccgggttccgttaggaacgtaaccgtacggtttaacgtttaccctacccgtaccgtttaacccgaaccctacgttaaccggccggttaacgacccggttaccgtaccggttaacggacccggggttaacctaacgggtaacggttaacgttacggggtacgggttaaccgtttacggggtttttacttaacccggttacgaacggttacgtaacgttaacggtattaacgttaacgtaccggttaccgtacgtacgttaccgggttgggacccgggtaaccggagtccgagacgtactaccgtaacgacgtttccggagtacgttnacctacgtacgttaccgtacttcccttacgttacccgttacccgg

SEQ ID NO: 4775 - DNA, 677 bp, Homo sapiens
  misc_feature: GYAE6OF02ILZMA.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatcgacccagtctccagactcccgtggctgtgtctcgtgggacgagacgggccaccatcaactgcaagtccagccaagtacgttgttttaaccacgacggtaccaaacgtaaataaagtaaacttaacttcgtcgttcggtaaccagaccaaggaaaacccaggacacgccctaccgtaagttcgactactaagtttacgtcgggactacgtaccggtacccggggtacggtccccggggttacctacgaccgtacttcgaggtccggacgacggcggtctagacgtactagtaagtttccactctaccaactactcacgcacgtccgtgtacgaggtacagagtagtgtcgtacgttagtttactacgttacgtacgtacgacgtaacgttaatagttacgttacgttccttacgttacgttacgttttacggggacccgggtaacgtaacggtcgtaggaacgtacgtaaccgaaacgtacggtacgtacggtaccgtctaccgacctacgttacgttcgtaccttacgtaccttcccg

SEQ ID NO: 4776 - DNA, 738 bp, Homo sapiens
  misc_feature: GYAE6OF02II304.39.31.C09.1.454.CMB.1.raw
  modified_base (207)..(207): a, c, t, g, unknown or other
  misc_feature (207)..(207): n is a, c, g, or t
  modified_base (253)..(253): a, c, t, g, unknown or other
  misc_feature (253)..(253): n is a, c, g, or t
tcagtcgcactagtcacgaccggtgctcgatttagacgtctcatcaaggaaggaaggggcgagcaagatggtgttgcagacccaggtcttcatttctctgttgctctggatctctggtgcctacggggacatcgtgatgacccagtctccagactcctggctgtgtctcgtgggcgagaggccaccatcaactgcaagtccagccanacgttcgtttacacgaggtaccaaacaaataaagaattacgttacnctttacggtaccagcaacggaaaccaaggacaaggcctccttaaagttcgcttactaacgtttaacgtggaccgaattccgtaaacccgggtaggtaccccggggtcccttacggaccgttaacttcgaacggccggacggtacgcggggttacagagacctagtacgttaccacgtcctacaacccgtactacacgacgtaacggtcctagccgaaggtacctagagtactaggtgtacgtagttaactcgtttcgacgtagaccgtagtaacgttacgtaacgttacgttacctacgttaacggtccgtttttaaccgggggacccggggggttaaacccgaacggttaccgttaacggggaacgtacgtttaaacccgaaagggttaaacttacgggttaaccggtcccggttaaacttaccgaaccccggttacttaaccccggggttttctttaaccgttacccgttaaccggttacccg

SEQ ID NO: 4777 - DNA, 643 bp, Homo sapiens
  misc_feature: GYAE6OF02FOIBH.39.31.C09.1.454.CMB.1.raw
  modified_base (295)..(295): a, c, t, g, unknown or other
  misc_feature (295)..(295): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaacaataagaattacttcgcttaggtaccagcagaaaccaggacagcctctaagttgctctatttacgnggctagtccgtacccgggagtcccgggtcctggaccgtattcgagccggagaggcgggtctggaagactaagtatttcgacttctaccaaccgactcgaagtccacgccctgacgacggcctaggaacgtatcggttagggacttaacggttttactttacgttacgtacgtaacggttactaagtttacgtttaagttacgttaacgttaccttacgtagttaccgttttcggggaacccggggtacaacggtcgttagggagtacgtaacgtaaacggtaacgtcggtaggtaccttacggaccctaaccgtattccgttacgtccgtttaccgtcttacccccgg

SEQ ID NO: 4778 - DNA, 734 bp, Homo sapiens
  misc_feature: GYAE6OF02IFNPN.39.31.C09.1.454.CMB.1.raw
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
  modified_base (429)..(429): a, c, t, g, unknown or other
  misc_feature (429)..(429): n is a, c, g, or t
  modified_base (519)..(519): a, c, t, g, unknown or other
  misc_feature (519)..(519): n is a, c, g, or t
  modified_base (542)..(542): a, c, t, g, unknown or other
  misc_feature (542)..(542): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtcgccgtacgggacagtcgtgatcgaccctagtctccagtacctccgtggctgtcgtctcgtaggcgagacggccaccgtatcaacgtgactacgtccagcctagtacgtttacgtttaacacgtacggtaccaaanaaagtaagtacttacgtcgtcgttacgtacgacgacgaacgaaactcggacncgtacctcgtaagtcgtactacgtaattccggacggtactacgtcggtaaccgggcggtacccggtctacgacgtactcgcggcggcaggtcgtcaggtacaccgtagttctacactaccacnctacgacgacgtacaccgtctaccgtagacgtactaacgggaaattcggtaaggttacccgtagtttaacgttaccgttagttaccgtanacgggttaacttaacgggtttanaacgtttacgtaccggttaccgttaacgtaacgggtttttacgggtaccccggggaacgggttaaccctaggtaccggttaaggtaacccgttaacggtaaaccgggtacctttacggtacgggtacgtacccggttactacccgtaccgtacgtttacccgttccggtaacttccccgttacttaccccgg

SEQ ID NO: 4779 - DNA, 775 bp, Homo sapiens
  misc_feature: GYAE6OF02IJFJ7.39.31.C09.1.454.CMB.1.raw
  modified_base (479)..(479): a, c, t, g, unknown or other
  misc_feature (479)..(479): n is a, c, g, or t
tcagtcgcactagtcacgaccggtgctcgatttagacgtctcatcaaggaaggaaggggcagcaagatggtgttgcagacccaggtcttcatttctctgttgctctggatctctggtcgccgtacgggacatcgtgatcgccagtctccagctcccgtgctgtgtctcgtgggcgagcggccaccatcaactgacacgtccagccgagtcgttgttttaaccacgtacggtaccaacgtaaataaacgtacttacttcgacgtttacggtaccagtcgaacgaaaaccgacggtacacgaccccttaccgttagttacgtcctacttagtttacgtcggtactaccgttaccggtaacccggggtacgggttccccggggttcccctacggtaccgtacgttcgacgggtccggcgtaacgggtcggtcgtaggacgtaaccgtcgtactttcgacctccttaaccgctaacgtccganccgtacgccgttcggacgacggttccgtaagaagtagttcggacgggtacttaagtttttacgtacgtttcgtacgagttacggttaacgtttaagtaacgttacgttaccgttaccctacggtttacgggtttaacggggtttcccggggaacccggggttaacccgaggttaccggcggttaaacggtacgttaaccggtaaaacgtccgggtttaacggtaccggttacgtaccgaccgttaaccgtacgtttaccctcgggttttacccttacccggtccttttacccccgg

SEQ ID NO: 4780 - DNA, 777 bp, Homo sapiens
  misc_feature: GYAE6OF02FORM7.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcccgtggctgtgtctcgtgggcgaggacgggccaccatcaacgtgcaagtccagccaggtagttcgtttacactacggtaccaaacaataagtaatttaccgttcgcgttaggtaaccaggaccgaaacgaacgaacgacgtaccgtcctaacgttagttctactacgttacgttacggcgacgtaccgtaccgggtaccgggtccgggtcccggtccgaccggtacgtcgtacgcggaccgtcggtacgggtcggtacgtacggaacgtaacgtaacgtttaccgttaccgtaccgtacctacctaactaccgtaaccgacgtaccgtaccgttaccgtacggacggtacggtaacgtaacggaacggttacgggttcggtaacggttacgttttaaccgtttacgtttacggtacccgtaagttaccggttaacgtaaagttttacgtaacggttaaacgttcccggttaacttaacgggtttccggttttaaccggggtacccgggggaacccgttaacggtccgtaaggggtacgtaagttaccgtaaaaccggtcggtagtcggtaacgcgttaccgaccttcgacgttaccgttcgttcctacgtcccgttaccccg

SEQ ID NO: 4781 - DNA, 837 bp, Homo sapiens
  misc_feature: GYAE6OF02IJRIS.39.31.C09.1.454.CMB.1.raw
  modified_base (181)..(181): a, c, t, g, unknown or other
  misc_feature (181)..(181): n is a, c, g, or t
tcagtcgcactagtcacgaccggtgctcgatttagacgtctcatcaaggaaggaagggcagcaagatggtgttgcagacccaggtcttcatttctctgttgctcgtggatctctgggtgccgtacggggacagtcgtgatcgacccagttcctccagtacctcccgtggctgtcgtctcgngggcgaggacggcccaccataccaactcgacgaacgtccagccgaagtagtttcgtttaacacgtacgtaaccaaactaataaagtactttacgtccgtgttacggtaccagactaacgaaaccgaggacacgtcctactagttcgtactcgtactttacggcgggctacgtaccggtaccgggtcgggtaccccggtcccgtaacggaccgttacgttaccggacggccggtacggtcgggtccgggtacgtaccgggacgtaacgtacgtttacctttaacccgaccttacccgtacctaaccgtacgtaccgtcgaaccgtacccggtcgtacgaccggtaacgggtacttaacgggaacgttagggttacggtacggttaaccgttttaaggttttaaccgttcgttacgttaccgggaacttaaaccgggttatttaaacggttaacgttaaccggttaacctttacggtaacgtttaaacccgggggtttccggggttaaccgggggtaacccggtaacggtaacggtacggttaacggtaacggttaaccgtaaaccggtaaaccggttcggtagggttacttaacggtaccctacggtaacccttcgtaacccgtttaacgtttacccttacggttacccttacccgg

SEQ ID NO: 4782 - DNA, 822 bp, Homo sapiens
  misc_feature: GYAE6OF02JGD8F.39.31.C09.1.454.CMB.1.raw
  modified_base (360)..(360): a, c, t, g, unknown or other
  misc_feature (360)..(360): n is a, c, g, or t
tcagtcgcactagtcacgaccggtgctcgatttagacgtctcatcaaggaaggaagggcagcaagatggtgttgcagacccaggtcttcatttctctgttgctctggatctctggtgccgtacggggcatcgtgactcgacccagtcaccagcctccgtggctgtgtctcgtgggcgaggacgggcccaccatccgaactggactaaacggtcccaaggcctaaggtagtttcgttttaaccacgacggtaccccaaaataataaacgtaactttacgttcgtcctttagggtacccaaggaccaagaaaccgtaggacctacggccttaccgttaaattcggcctactaagtttacggngggacctaacgttcccgtaacccgggggtcgtccccggggttccccaggtaaacccgtagttcccgagggccccggagttaacgggccgggtttaacgtcggaagaaaccgtttaggttacttttccggaaccttccttacccggaattacgcctaagtccaccggcccgttaaacggcgaaagtttccggaacggtaaagaccgtttcgggacgtttaacggtaaagtttttacccttaggttactaggtaaacctggtaatttaccggttaaacttggttaaccggtacttcggtacgttttaacgggtttcggggaaccggggttaaccttaaggtccgggaagggtaacggttacttaaccgggtaaaccgttacgggtttcgaaggggttcccctaagggacgtttacccttacggttccctgttttaaaacccggtttctacccggttttaccccg

SEQ ID NO: 4783 - DNA, 721 bp, Homo sapiens
  misc_feature: GYAE6OF02IPCFN.39.31.C09.1.454.CMB.1.raw
  modified_base (150)..(150): a, c, t, g, unknown or other
  misc_feature (150)..(150): n is a, c, g, or t
  modified_base (449)..(449): a, c, t, g, unknown or other
  misc_feature (449)..(449): n is a, c, g, or t
  modified_base (683)..(683): a, c, t, g, unknown or other
  misc_feature (683)..(683): n is a, c, g, or t
tcagtcgcactagtcacgaccggtgctcgatttagacgtctcatcaaggaaggaaggggcagcaagatggtgttgcagacccaggtcttcatttctctgttgctactggatctgtggtgccgtacggggacatcgtgatcgacccagtcncgagccgtccgtggtcttgtgtctcggtgggcgaaggcggccacatcaacgtgacaacgccgagctagtagttcgtttaacacgtacggaacaaacgaaagtaagtaacttcgtcgtacgttcggtaaccagaacaaacgaaaacgaggtaccagtaccttaacgttagtgctagttacgttagcggactacgacgtaaccgggcgtacccggtccgtacgaccgtagtccgaggacggacggttacggcggtacggtacgaaacggtagtacttagtaccctactacgacaccgttancgtacgacggtcctagcgagtacggagtaaggagtacggttcgaacggtttagtttaacttacgtaacgacggtaaacgtagttaacgtaaagtttacggaacgtttaacggtaccgttacgtaaccgggttaaacgttccggggttaacccggaaccgggtctaaacgggtccgtaagtaacggaaccgtttaacgaaacggttcgtagacccggttaacaccgtttaaccgntttaacggtccttaccgtaacgttcccgtactacccgg

SEQ ID NO: 4784 - DNA, 793 bp, Homo sapiens
  misc_feature: GYAE6OF02GRBN4.39.31.C09.1.454.CMB.1.raw
  modified_base (117)..(117): a, c, t, g, unknown or other
  misc_feature (117)..(117): n is a, c, g, or t
tcagtcgcactagtcacgaccggtgctcgatttagacgtctcatcaaggaaggaagggcagcaagatggtgttgcagacccaggtcttcatttctctgttgctctggatctctggtnccgtacgggacatcgtgatcgaccagtctccagactcctggctgtgtctcgtggacgtagagggtcccacatcgaactggacaagtccagtccagagttcgtttacacgacggtaccaaacaataacgtaacttacttcgacgttaggtacctacgacaacgtaaaccgtaggaaccaggtcccttaacgtaagtgactcgtaattttacgcgggtacacgttccgtaaaccgggtaggtacccggggtaccctaggtaaccgtagttaccgacgggacccgacgtacgggtcggttctaggacttaacgacgtttacgtttacaaccgtcctaccgaaccacgttaccgaacgtaccgacgtaccgtacgtaacgtacgggtaaccgttaaggaacggttacgttaggtaaccgggttacgttaaaacgttttaacgttaccgtttacggtaaccgtaacggttaacgtaacgttaacgtttaaacggttaacggttaaccggttacccgtttaacgttaacgggtttaccgggttttccgggggaacccgggttaaccgtaaacggttacggtacgtaacgtaccgtaacgtaaccgtacgtacggtaacggtcgtaaccggtaccgtaacttccggtaccgttaccgtttacccgttacctaccgttaccccg

SEQ ID NO: 4785 - DNA, 893 bp, Homo sapiens
  misc_feature: GYAE6OF02JNTKG.39.31.C09.1.454.CMB.1.raw
  modified_base (99)..(99): a, c, t, g, unknown or other
  misc_feature (99)..(99): n is a, c, g, or t
tcagtcgcactagtcacgaccggtgctcgatttagacgtctcatcaaggaaggaaggggcagcaagatggtgttgcagacccaggtcttcatttctctnttgctctggatctctggtgcctacggggacatcgtgatgacccagtctccagactccctggctgtgtctcgtggcgagacgggccacgatcaactcgacaacgtccagccagagttgtttacacaggtaccaacaataagaattacgttacgcttcggtaccagtacacgaaaaccgaggtaacacggtccctaccgttaacgttcgacctactacgtttaaccgtgggcctaacgttcccgtacccgggaccggttccccggggttaccccgtacgtaccccgtacgttaccgtacggtccgggtaccacgggtccggggttaccgttacggaagggtaacctacggtaacgtttttacccgaccttttaccggttaacccaaccgtaacttaccgtaacgaccgggtaacgtcccggttgtaacccggtacggttaccgtaacggaaacggtttaacggttcggttaacgggttaacgggttttaactttttaacggtttaacccttttaccgggtaaccttaaccgggttaaccttacggttttaagttaacggtttacggttaacccgttttaccccggttaccgttaacggttttaaccgggttttacccgggggtaccccggggtaacccggttaaaaggtcccggttaacggggactaccggttaaacggtaaaccggttaaaccgggttccggaacggggttcccgtttaaccggacccgtttaacccgggtaacctttacccgggtttacgttaccccggttacctttaacccgtttacccccgg

SEQ ID NO: 4786 - DNA, 770 bp, Homo sapiens
  misc_feature: GYAE6OF02I3T7E.39.31.C09.1.454.CMB.1.raw
  modified_base (394)..(394): a, c, t, g, unknown or other
  misc_feature (394)..(394): n is a, c, g, or t
tcagtcgcactagtcacgaccggtgctcgatttagacgtctcatcaaggaaggaaggggcagcaagatggtgttgcagacccaggtcttcatttctctgttgctctggattctctggtcgccgtacggggacatcgtgatcgaccctagtcctccagtacctcccgtggctgtgtcctcgtgggacgtaggacggccaccataccaactgtacaacgtccagccagtagttcgtttacgactacggtaccaaacaaataacgtaacttacttcgtacgttacggtaccagactaaacgaaaccgaggaccacgtccctacgttaagttcgctactaatttacggaggcctacgtaccgtaacccgggacggtcccgggtacctacgtaaccgtnttaccgacggtccggacgacggtacggtacttacggaaacgtacgtactaacgtttaccacttacctaaccgtaacctactacccaacggtcctaccggtacctacggaacgtacggtacgtaaacggtacggtaacgttcgggtaacgttacgttaaacgttttacgttaaccgtgttacgacgttaacggtaatttaacgttaacgtaacgttaccgttaccttacggtttaaccgtttaccgggttaccggggtaccgggtaaacctaggtacgttaggaccgtaacgtaaccgtaaccgtaaaggttccggtacgaccttcggaccttaaccggctttacccggttctaaccgtttccgacccgtttacccg

SEQ ID NO: 4787 - DNA, 707 bp, Homo sapiens
  misc_feature: GYAE6OF02FUHYV.39.31.C09.1.454.CMB.1.raw
tcagtcgcactagtcacgaccggtgctcgatttagacgtctcatcaaggaaggaagggacagcaagatggtgttgcagacccaggtcttcatttctctgttgctctggatctctggtgccgtacgggacatcgtgtatgacccagtctccgagtactccctggctgtgtctcgtgggcgaggacggcccacgactcaactgacgaacgtccagccagtagttcgtttacacgaggtaccaactaataagtattaccgttgtcttaggtaccagacacgaaaccacggacacgcctacgttaagtcgtctactagtttaccgtggacagttaccggtacccgggtacggttcccgggtccgtcggaccggtactttccgaaggtccggtacgacggccggttcgtacgacgaacctggtactttaccgacgttaccgtcctaacccgagttccggaacggtacgaccgtccgtacgtacgacggtcgtaggtaaacgtaggtagttacggtacgttaacgttttacgttacgttcggtacgttaggtacttagttaatttaacgttagttaccgtacgttacgtacgttacggtttaccgggaccggggaaccaagtcggtacggtacgtacgtactaacggtccgtaggtaccgtcgttacgaccgtaccgtagttccgttagtaccgttacgtccgtttaccccgg

SEQ ID NO: 4788 - DNA, 636 bp, Homo sapiens
  misc_feature: GYAE6OF02FPE6E.39.31.C09.1.454.CMB.1.raw
  modified_base (325)..(325): a, c, t, g, unknown or other
  misc_feature (325)..(325): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtaccaaacaataagaattacttcgcttggtaccagcagaaaccaggacagcctctaagttgactcatttacgtggcatccgtacccgggagtcccgggtccngaccgtattcacggcggcacgggcggtctgacgactagtactttcacttcctaccaacctatccgagaccacgtccctcgacgtacggcgtaggaagtagtggtacggtacttagtttacttacttagtacgtagtacgtagttaagtttagttaacgttacgttccttacgtaacgtttaccggttttacggggacccggggtaaccgaaggtccggtagggtaaggtactaaccgtaaaccggtaacgttacggtacgtacgtcgaccgtacccgtacttaccgttgtcctttaccgtaccttaccccg

SEQ ID NO: 4789 - DNA, 832 bp, Homo sapiens
  misc_feature: GYAE6OF02I30OT.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtctccagactcccgtggctgtgtctcgtgggcgagacggccaccatccaactgctaagtccagaccagtagttcgttttacacgtagtaccaaacaataaagtaacttaccgttcgtacgtttacggtacccaagtaccgaaaggaaaccgacggaaccacggtaccccttacccgttaaaggttcgtaccttacttaacgttttaccggtacggggacccttaacggttacccggttaacccccgggggtaaccggggtttcccccgggggttacccccgttacgggtaaaccccgtacgtttaccggaccgggtcccgggacggtacgggtccgggttaccgtcgggtaaacgaccgtacgttaacgttttccctaactccgtacgaacctacgttacgacgaccgcgtcccgtagacgtcgacgtagaaagtcgtaggtcggtacttaacgtttcttaacgtggttacgtacgtaccgtagtttatttaacggttcgttaaccggttacccttaccggtaaggtttacccgggtttacccggggaaccggggttaaccttaacgggtaccggttaacggtagttaaccgtaaccgggtaaaccgtaccggttagggtcccgggtagtaacccgtaccttacgttaccgtttcgtaccgtttacccttcgttaccccgttaccgg

SEQ ID NO: 4790 - DNA, 925 bp, Homo sapiens
  misc_feature: GYAE6OF02G5YX6.39.31.C09.1.454.CMB.1.raw
tcagtcgcactagtcacgaccggtgctcgatttagacgtctcatcaaggaaggaaggggcagcaagatggtgttgcagacccgaggtcttcatttctctgttgctcgtggatctcgtggtcgaccgtacggggacatcgtgatcgacccagtcctccagacctccctggctgtcgtctcgtgggccgaggacggcccaactactcaaacgtgacgtaacgtccgagccaaggtagtttacgtttaacacgtacggtaacccaaactaaagtaaacgttaacttaacgttccggtacttacgggtaaccaacggaacctaaacggtaaaacccgaacggtaaccaccggtacccttaccgttaaaggttcgaccttacttaagttttaaccggcggggtaacctaccggttaccccgtaacccggggtacggttacccccggggttcctacggtaaccgtacgttacgacggccggtacgtaacgggtccggttacgaacggtaaccgtaaacgtacggttaacgtttacccaacgtttacccgtaacctaaccgtaaccgtaaccgaacgtacccgtaaccggttcccgacgtaacccggaggttaacccgtaaagggtaaagttacggtacggttacggtaaacccggtttaggtttttaaacaccggtttacgacccgtaaaggacgttaaacgtttaaacgttaaacggtaacgtttacccggatttaaccccgggtaaacgttttcggggttaacccggggaaccgggtttaaacccacggggttactaaccgggtaaactaacgttaaacccggaaaacgggtttaccgtagggttaaccgaaccgttaccggaaccccgttaagttacggtttacccggttacggttaccctttaacccgtaccggttaaccccccggg

SEQ ID NO: 4791 - DNA, 813 bp, Homo sapiens
  misc_feature: GYAE6OF02FOBB7.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtcgccgtacggggacatcgtgatgaccagtctccagacctccctggctgtctctcgtgggcgaggacgggccaccataccaactgcaacgtccagaccaggtacgttgtttaccacgtacggtaaccaaaataaacgttaaagtaactttaaccgttccggtacgtttacgggtaacccagtaccaaacggtaaaaccgacggaaccacgtccccgttaaccgttaaggttcggtaccttacgttaacgttttaccggtggggtacctacgttacccgggtacccggggtacggttccccggggttaccctacggtaaccggtacttccggaacggtcccgggtaccggtacggggtcccgggtacgttacgggaaacgtacggtaaacgtttacttttacccgaccttaccctaccgtaactacgttaccgacgtaccgtaaccgcccgtaggaccgtacgggacgttaacggaggtacgttacggtacgttaccgtttaacgtttacgttacttacggtactacgtacgttaagttagttacgttacggtacttccgtacgtaccgttttcggtaccgggccgtacgtacggtcgtacgggtactacggtaaaccgtaggtcggtaggtccgtacgttaccgaacccgtttactccgtttaccgtccggtttacttcccgtttacccgtccccgg

SEQ ID NO: 4792 - DNA, 730 bp, Homo sapiens
  misc_feature: GYAE6OF02IEIK8.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagacggccaccatcaactgcaacgtccagccagtcgttgttttaacacgaggtaccaaacaataaagaacttacttcgcttaggtaccaggacaacggaaaccacgggacacgaccccttaccttaaaggttcgacctactaacttttaccgtcgggactacgttaccggtaacccggggtacggttccccggggtccctacgggtaaccccgtacgtttacgaacggtcccgggtacgacgggtccggggttactcgggaagaccgtaaggtacttttaccaccgtacctaccgtaaccctaatccgacgtaccgaccggtccttacggccggtaacggtccgtaaggaaacgttagtacggtgggtaccgttaagttttacgttacgttcgtactaggtcttaaagttacttaagttaacgttacttacccgttagtaacggtttacggtttaccggggaccgggtaactacggtgtacggacgtacacgtaaacgtcgtcggtacgtctacgacctacgtcttacgttaccggtcttaccgtagttccccg

SEQ ID NO: 4793 - DNA, 810 bp, Homo sapiens
  misc_feature: GYAE6OF02GNBDH.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctcgtggtgccgtacggggacatcgtgatgacccagtctccagactccctggctgtgtctcgtgggcgagacgggcccaccgattccaacgtcgacgtaacggttccacggaccaaggtagtttcgtttttaaccaccgtacgggtacccaaaactaaactaaaacggtaactttaaccgttccggtacgtttacgggtaccagtacaacggaaaaccgaggaaccacgtaccctaccttaagttcgtcctacttaatttacgtgggtacctacgttaccggtacccggggtacggttccccggggtccctacggtacccgtacgttacacgggtccggtaccgacgggtccgggttactacgggaactaacgtaggttacctttcacccgttactcctaaccgtactacgacgtaccgaccgtcgtacgacgtacggtaccgtagaaacgttacggttgggttacgggtactttaacggttttacttaccggttagttaccgtaacgtacgttaaatttacttaacggttaacggtacctttccgttaacgtacgggtttaccggttttacgggggaccccgggtaactacggttacgtaaccgggagtaacgtaacggtaaacggtacggttaggtaccgtacgtacccacgttaacccgtagttaccgtttcgtacgttaccgtaccgttaccccgg

SEQ ID NO: 4794 - DNA, 827 bp, Homo sapiens
  misc_feature: GYAE6OF02GVZMJ.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagtagtgtttacacaggtaccaacaataagtaatttacgttcacttggtaaccagcaacgaaaccgaggacaggcctacgtaagttcgctactactttacgcggtacaacgttccgtaacccggggacggttcccggggttacccctggtaaccccggtactttccggacggcccggtaccgtaacgggtccgggtccgttacgacggaacctaggttaaacctttttcccgaaccgtttaccttaccgtaaccccgtaacttaccgaacggtacccgtaacggtccttaccgggaacctaacggggtacccgttaagggtaaacgttaacggtttcgggttacggggtacctttaaaggtttttaaacgttaccggttacggttaacccgtaggttaaacccgtaagttttaaaccgtttaaggttaccggttaacggttcccttaaccgggttaacggtttccggggttttaaccgggggacccgggggtaaactaaacggtccggtaagggtaaccgtaccgttaaacggtaaaccgttacggttcggttaacggtcttaacccgggattaaacccgtcgttttaccgtcgtttacctaccgttaccgttacccccgg

SEQ ID NO: 4795 - DNA, 760 bp, Homo sapiens
  misc_feature: GYAE6OF02FPA5I.39.31.C09.1.454.CMB.1.raw
  modified_base (102)..(102): a, c, t, g, unknown or other
  misc_feature (102)..(102): n is a, c, g, or t
  modified_base (335)..(335): a, c, t, g, unknown or other
  misc_feature (335)..(335): n is a, c, g, or t
  modified_base (433)..(433): a, c, t, g, unknown or other
  misc_feature (433)..(433): n is a, c, g, or t
tcagtcgcactagtcacgaccggtgctcgatttagacgtctcatcaaggaaggaaggggcagcaagatggtgttgcagacccaggtcttcatttctctgttnctctggatctctggtgccgtacggggacatcgtgatgacccagtctccagactccctggctgtgtctcgtgggacgaggacgggccaaccatcgaactgacaacgtccagccagtagttacgttttacacgtcggtaccaaacaaataagtaattactccgtacgttcggtaaccaggaccaagaaaaccgaggactacgcctaccttaaggttacgtctcgtaatttacggnggtactatccgtacccgggaggtcccgggtcctcgaacgtctacgacgtcggacgacggtcggtcgtagacgactagtacgtctcgtcacgtaacccngttaccgagaccaccggtctagccggtacggtacgtagaaaggttcgttagggttcggtaccgtttagttttacctagtttcggaccgaagttacgtagtttaacgttaggtttaagtaaccttcggtaacgttacgggtttaccggtttttcgggggaacccgggggtaaacccttaacggtacgggttaagggtaaccgttacggtaacccgtaaaaccggggttcccttaggggttaaacgggtcccctttagggaccccctaaacgtttcccgtttacggtttaccctttaacccgggtttaccctacggtttaacccccccg

SEQ ID NO: 4796 - DNA, 897 bp, Homo sapiens
  misc_feature: GYAE6OF02JW2X1.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatcgacccagtctccagacctccctggctgtgtctcgtcgggacgaggacgggccaaccatcgaactcgacacgtaccacgccaagtagttacgtttacactacggtaccaaataagtaaacgtaacttaccgtcgtacgtttacggaaccagtaccgaacggaaaaccgtaagggtaaccacgtacccgttaaccgttaagttcggtaccttaccgttaagtttaccgggtaacggggtccttaaaccggtcccggttaacccggggggtaccgggtttccccggggtaccccgtaggtaaccccggttacgttaccgaacgggtcccggggtaccggtacgggtacccgggtttgtacgggtaaaccgtaacgttaacgggtttaacctttttacccccgaacctttacccgtaacctaaaacccgttacgaaccgtaaccggtaccgtaaccgtcccggttaacgcgggtaacggttaaccgtaacggtaacggtacggttagggtttcccggtaaacgtttaacgtttttacgtaccggttaccggtaagttacggtaacctttaaggttaaaggtttaacgttaccgggtttacctaccggttacggttaaccgggtttaccgggttaacccggggacccggggttaacgtacgggtaaccgttcggaaagttaccggtaaaccgtaacggtacggttacgtacggtactaccgacgttacctacggttacttcgttaccgtttacgccttacccgg

SEQ ID NO: 4797 - DNA, 832 bp, Homo sapiens
  misc_feature: GYAE6OF02FSNOQ.39.31.C09.1.454.CMB.1.raw
  modified_base (342)..(342): a, c, t, g, unknown or other
  misc_feature (342)..(342): n is a, c, g, or t
tcagtcgcactagtcacgaccggtgctcgatttagacgtctcatcaaggaaggaaggggcagcaagatggtgttgcagacccaggtcttcatttctctgttgctctggactctctggtcgccgtacggggacatcgtgatgacccagtctccagactccctggctgtgtctcgtgggcgaggacgggccaccatcaacctgacaagtccagccagtagttcgtttaacacgacggtacccaaactaataaagtaacttacttccgtacgttcggtaccagacgaacgaaaccgaggacctacgtacccctacttaaggttctacctcttaacgttttacggngggtacctaccgttaccggtaacccgggggtaccggttccccggggtccccgtacgggaacccgtagttaccgacgggtccgggacgacgggtaccggggttctagggacgtacgtacgttaacgtttccaccgttccaccgtacctacgttaccgaacgtaccgaccggtacgttaccggaccggtacggtactaacgggtaagtacggttacggtacgggttacctttaacggtttttaacgttacgtacgttaccgtacggtagtaagtttaaacttacggtttaagttaccggttacccgttacggttacggtttacccgggtttaccggggaaccggggttaaaccgaaacgggttacgggtacgggtaaagtcccggtaaacgtaaacccggtcggttacgggtaccggttcctacggtaacccgttaacccggtactttaaccggtttcccgtttactttaccggttaccccggtttaccccc

SEQ ID NO: 4798 - DNA, 655 bp, Homo sapiens
  misc_feature: GYAE6OF02HAMLF.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagttgttttacacacggtaccaacaataagtaattactcgtcttacggtaccagacaacgaaaccaggacacgtccctaccgtaagttgctactactttacgtgggactacgtaccggtacccggggtacggtcccggggtccctacggaccgtactcgacggcggacgacggcggtctagagacgtagtactttaccactcctacaacctatccgagcgtacgcctgacgaggtacgtagaagtagtggtacgtacttaagtttacttacgttcgtacgacgtacgttagttattagtacgttacttacctacgtacgttacgggtttacggggaccgggtaaccgtaaggtcgtacggagtacgtaacgtaaaccggtacgttagggtacggtcgtaccgaccgtacctacggttaccgtcggtttacttccgtacgttaccccg

SEQ ID NO: 4799 - DNA, 907 bp, Homo sapiens
  misc_feature: GYAE6OF02JLGJC.39.31.C09.1.454.CMB.1.raw
  modified_base (141)..(141): a, c, t, g, unknown or other
  misc_feature (141)..(141): n is a, c, g, or t
  modified_base (632)..(632): a, c, t, g, unknown or other
  misc_feature (632)..(632): n is a, c, g, or t
tcagtcgcactagtcacgaccggtgctcgatttagacgtctcatcaaggaaggaaggggcagcaagatggtgttgcagacccaggtcttcatttctctgttcgctcgtggactctcgtagtcgccgtacgggactatcggngatacgacctgtctccacgacctccgtggctagtcgtcctcgtgggacgaggtacggaccacgactaccgtaactcgaacgtaaccgtcaacgaccgtaagtaacggtttctttaaccgacgtaaccggtaaccaaaactaacgttaaacgtaacgtttaccgttaccggttacgtttacggaaaccctaggtaaccgaaacggaaaccggtaacggtaaccgtaaccgtaacccttaaccgggttaaagttaccggtaaccccttaacggttttaacgttttaacccgggacgggtaccgttaaccgttaacccccggggttaacccggggtaaccggggtttcccccgggggttaaccgttaacggtaaaaccccggttagggttttaaccccggaacggcccgggggttaaccgtaccggggttaacggggtaccctagggaaacgttaccggttaacgtttaacctttaccgacttaccccgttaanaacccggtttacacggtaccgaacgtcccggtacgtaccgtacggtacggtaccgtaacggtacgtacgttaggtacgttacgttacgttacgttacgtcgtaacgtcgtaacggttaacttaagttacgtacgttaaccgtactacggtaacggttaccgggttaaccgggacccggtaagtaccggttacgtacgtaagtaccggtaaccgtaacgacggttccgtagtacccgagaacctagttcctacggttactccttacgaccgtaccg

SEQ ID NO: 4800 - DNA, 894 bp, Homo sapiens
  misc_feature: GYAE6OF02HM9H2.39.31.C09.1.454.CMB.1.raw
  modified_base (541)..(541): a, c, t, g, unknown or other
  misc_feature (541)..(541): n is a, c, g, or t
tcagtcgcactagtcacgaccggtgctcgatttagacgtctcatcaaggaaggaaggggcagcaagatggtgttgcagacccaggtcttcatttctctgttgctctaggatctctggtcgccgtacgggacatgtgatacgacccagtcctaccacgtacctccccgtggtcttcggtcttccgtcgttaggggacggacggaaccggtacccaaaccgtacttaccgaactacgacgaaccgtccacggaccgtaaggttacgtttacgttttaaccacgtacggtaacccaaacgtaaagtaaaacgttactttacgttccggtacgtttaccggaacccagaaccgaaaccggaaaccacggacctaccgcccgttacgttaacgttcgtaccttacttagttaacgcggacctaccggttacccggtaccgggtaccgggtccccggtaccgtacgtacccgtagtccgaggccggacgacggtccgggtactacggaacacgtagtttacctcgtaacctctaccaaactcgtacnccgtcgtaccgtccgtacgacggtaccggagtaagggtacgtacggttggttaacggttacggtttaaacgttttaacggttacgttacggttaaccgtacggttaacgtttaagtttaaacggtttaagtttaacccggttaccgttaaccgtttaaccgggtttacgtttcccgggggttaaccggggtaaccggtaacccggttaaacggttaaacgggtacgggttaaacgttaccgtaaaacggttaaacccgggttaaacggttaacgggttaccgtaaccgggttacccaacgttaccgttaccgttaccgttttggtttacccctttaccgtccgtttaccccgg

SEQ ID NO: 4801 - DNA, 858 bp, Homo sapiens
  misc_feature: GYAE6OF02FQNFE.39.31.C09.1.454.CMB.1.raw
  modified_base (305)..(305): a, c, t, g, unknown or other
  misc_feature (305)..(305): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagtccagagtgtttacactaggtccaagaactaagaattaacttcgacttggtaacctagcaaggaaacctggactagcctacctaagttgactctaatttacgngggtcacgtccgtaacccgggtagtcccggggtcctcgaccgtacgttacgacggtcgacgtacggcgggttacctagaacggtaacgtacggtaactttttacgaaccgttaccgtaccgtaaaccgtacgttaccgaaacggtacccgtaacggttcccgtaaggtacccgtaacggggtacccgttaagggaaaaccggttacggttaacgggttcgggtaaccgttaacgggtttttaaaccgtttaaccggttacgggtttacccgtaaacgggtacccttaaacgggttttaacgttttaaacggttaacggtttaacccggtttacccgttaaccggttaaccggtttaccgggtttttaccgggggaacccgggggttaaaccctaaacgggttcggttacgggtaaccgtaaccgttaaaccgtaaaacccgggttaaccggtttaaggtaccgggttaacccgttaccgggtaaccctaacccggttaacgtttacccgttaccgggtttaaccctttaccggttaccgttttaaccccccgg

SEQ ID NO: 4802 - DNA, 717 bp, Homo sapiens
  misc_feature: GYAE6OF02H4ZZ1.39.31.C09.1.454.CMB.1.raw
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
tcagtcgcactagtcacgaccggtgctcgatttagacgtctcatcaaggaaggaagggcagcaagatggtgttgcagacccaggtcttcatttctctgttgctctggatctctggtgcctacggggacatcgtgatgacccagtcctccagactccctggctgtgtctcgtgggcgaggacggccaccatacaactgacaacgtccagccagtagttgtttacacacggtacaaacaaataaagtaattacttcgtcgttacggtaccaggacaacgaaaccgaggaacacgcctacgtaagtnctatattacgaggacagtccgaccggtcgtccggcctgacctntcgagcgngacgcggtcaganacagtactctacnctccactatacacgcacgtccgtagacgtacgacgtacgaaagtgttacggacggtaacttaggttttaaacgtcgttacggtactaacgtacgttaaaggtttaacttaaaggttaacggttaaccgttaccttaaccgggtaaccggttttaacgggttttacccggggggaacccggggttaaaacccgaagggtaacccggttaacgggtaaataaccgttaaaccggtaaaaacccggtgttaaacggggtccgtaacgttaccggtaaacccgtaccgttaacgtttcccgttaacgttttacccgtttaccctaacctttaccccccgg

SEQ ID NO: 4803 - DNA, 760 bp, Homo sapiens
  misc_feature: GYAE6OF02FIYOF.39.31.C09.1.454.CMB.1.raw
  modified_base (177)..(177): a, c, t, g, unknown or other
  misc_feature (177)..(177): n is a, c, g, or t
  modified_base (373)..(373): a, c, t, g, unknown or other
  misc_feature (373)..(373): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactcctggctgtgtctctgggcgagngggccaccatcaactgcaacgtccagccagtagttgtttacaacaggtccaaacaataaagaattacgttcgtcttacggtacctagacaagtaaaccagggaacacggccttacctaagttcgctctattttacgcgggtcacgtccggtacccgggaggtccccgggtccgtcgaaccggtattccgagccggntacggtccggtcgtggaacgacgtagtactttcgacttccgcctaacccacttcgaacgccgacgtcccgtacggtaccgagggtccttaacggaaaggtacttgggtaccggtcgtttaacggttttaatttaaccgtcggttaaccgtaggttaaccgtaagttttaagtttaaacggttacgtttaaccgttacccgtttaaccgtaacggggtttaccggtttttaccgggggaacccggggttaaacccgtaaacggttccgggttaacgttaacgggttaaccgtaaccgtaaaccgggtaaacggttccggttaacgtcccgtaccgggtaccctaacggtactttacccgttcgtttcccgttataccccgtttacccg

SEQ ID NO: 4804 - DNA, 782 bp, Homo sapiens
  misc_feature: GYAE6OF02FL23I.39.31.C09.1.454.CMB.1.raw
  modified_base (236)..(236): a, c, t, g, unknown or other
  misc_feature (236)..(236): n is a, c, g, or t
tcagtcgcactagtcacgaccggtgctcgatttagacgtctcatcaaggaaggaaggggcagcaagatggtgttgcagacccaggtcttcattctctgttgctctggatctcgtggtgcctacggggacatcgtgatgaccctagtctccagactccgtggctgtgtctcgtgggcgagcggccaccatacaactgacaagtccagccgagtagttgtttacacacggtaccaaanaagtaagtaacttacgttaccgcgtttaggaccctaaggccaacgtaaaccgaggaacacggtcccttaccgtaagttcgacgttctattttaacggtgggactaacgtccggtaaccccgggtacggttacccggggttcccctcggaaccggttgtaccggtaaggccggtcgacgggtccgggtacctaggactacgaagttacttttcccgacttccgtaccgtaaccgtaactcgtaacggacctaacggtcccgtaggacctacgggtacgtaaaggaacggttaacggttcggaacggttacgtttaacggtttacgttaacggttacgtaccgtaaggtacttaacggtttaacttaaggttaacgttccggtaaccttacgtaacggtttaaaccgggttttcggggaacccgggtaaccgtaacggttcgtacgggtaaccgtagaaaccggttaaacgtaaccggtgttaccgggactttaccggccaaacgtttccgttccgtaacggtttcccttacgttccgttacccccgg

SEQ ID NO: 4805 - DNA, 776 bp, Homo sapiens
  misc_feature: GYAE6OF02F9JYU.39.31.C09.1.454.CMB.1.raw
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
tcagtcgcactagtcacgaccggtgctcgatttagacgtctcatcaaggaaggaaggggcagcaagatggtgttgcagacccaggtcttcatttctctgttgctctggattctcgtggtgccgtacggggacagtcgtgatcgaccgatcctaccagacctcccgtggtctgttgtctcgtgggcgagcggaccacataccaactgacacgtcgacgaccagtacgttcgtttacgaacaccggtacaacaagtaagttacttcgtcgtagttacgtaccgagacaacggaaccgaggacacgtacctagtaacggtcnctaacgtnttacggcggactacgtaccgtaccggtaccggtccggtaccgtacgtaccgttacttcgacgggtccggtacgacgggtcggtttacaacggtcggtaacgtacgttaaccgtttacgtaacctttccggaaaccttacgaccttaacggaccgtacggtaaccggtcccgttaacggacccggtatacgggttaaacgacggttacggtacggttaaccggttaacgtttacgttttaaaccgttaccgtttacggaaccgtaggttaccttaaagtttacgtttaaccgtacgttaccgttacttccgtaacgggttttaccgggttaccgggaaccccggggtacctaaggtttacccgagttacggtaactacggtaacccgtaagggtcgtacgtacgacgtaccgtacggtctaaccgtttcgtacttccggtacttaccccg

SEQ ID NO: 4806 - DNA, 790 bp, Homo sapiens
  misc_feature: GYAE6OF02IUM23.39.31.C09.1.454.CMB.1.raw
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtctccgagacctccgtggctgtgtctcgtgggcgaggcggccacactcaactgacacgtccgacgccagtgttacgttttaccacgtacgtaccaaactaaagtaaagtaactttacgttcgtacgttacggtaccacgtacgaacgaaacgacggaacacgtccttacgtagttcgactactacgttacgtggactcgttaccggacccgggtacggtccgggtccctaggacctagtaccgacggccgacgacggtcggtctacggacgactaggtactttaccgactcctaccacctactacgacgacgtacgtccacggcgtacgggtctaaggtaaaggtcgttgggtacgttacggtttaacgtttaacttgtaccggttagaacgttacgtttaacgtttagttaacgtttacgttacccgggttaccttacgggtttaagggtttcccggggtttacccgggggaaaccgggtacccgtaggttaccgggtaacgttaaaccggtaccgttaaaacgggtaaccccggtttaaaggttccgggtaacgggttaccccttaagggacccccttaagtttacccgtttacccggtttaacgttttaccccgtttacgttaacccccttttcccccgggg

SEQ ID NO: 4807 - DNA, 809 bp, Homo sapiens
  misc_feature: GYAE6OF02G8GY1.39.31.C09.1.454.CMB.1.raw
  modified_base (646)..(646): a, c, t, g, unknown or other
  misc_feature (646)..(646): n is a, c, g, or t
tcagtcgcactagtcacgaccggtgctcgatttagacgtctcatcaaggaaggaaggggcagcaagatggtgttgcagacccaggtccttcatttctctgttgctctggatctctggtgcctacgggacatcgtgatgaccagtctccagactccctggactgtgtctcgtgggcgtaaggacgggcccaacctaagtacaaaccgtacgaccgaaacgtcccacgaccgtaaggtaacggtttacggtttttaaccaacgtaacgggttaaccaaaaaccctaaaagttaaaacggtaaaactttaaccgtttaccgtacgttttaaccgggaaaccctaaggaaccaaaacggaaaaccccgaaggaaccaaccgtacccgttaacccgttaaagttcgaccttaccgttaagttttacgacggggacctacgttaacccggtaacccgggtacggtccccggggttaccctacgggaaccgtacttaccgacgggacggaccgaacgggtccggtacgtagaaccgaacgtacgtaacttttacaccgttctaacacccgtatacgacgaccctaggtcccgtagaccgtacgacgttaggaagtacgtggtacgtacgtttaagtttactacgtacggttanacgacttaaagttataacgtacgttaaccgtcgtacgttaacggttcggtttaccgggaaccgggtaacgaacgtacgtacgggtaactacgttaaccgaaacgttacgtagtacggtcacgtacgaaccgtattaccgttactacccgttataccttacccg

SEQ ID NO: 4808 - DNA, 696 bp, Homo sapiens
  misc_feature: GYAE6OF02JWOMW.39.31.C09.1.454.CMB.1.raw
  modified_base (494)..(494): a, c, t, g, unknown or other
  misc_feature (494)..(494): n is a, c, g, or t
  modified_base (626)..(626): a, c, t, g, unknown or other
  misc_feature (626)..(626): n is a, c, g, or t
  modified_base (670)..(670): a, c, t, g, unknown or other
  misc_feature (670)..(670): n is a, c, g, or t
tcagtcgcactagtcacgaccggtgctcgatttagacgtctcatcaaggaaggaaggggcagcaagatggtgttgcagacccaggtcttcatttctctgttgcctctggatctctggtcgccgtacgggacagtcgtagatcgaccctagtctccagtacctcccgtggtctgtgttctcgtgggcgacggacggccaccactacaacctcgacgtaacgtccagaccgaagtacgtttacgtttacaaccgacggtaccctaaacaactaaacgtactttacgtcgtcgttacggacacgacaacgaaaccgtaggacctacgtcctacgttatcgtccttacgtagttaccgcggtactaccgtcccgttaaccgggccgttcccgggtaccgtaccgtaccgtactcgcgcggacgaggttcggctaggacgtactataccgtttacaccgttactaccactactcgacgtaccgtacgtccgtacggacncggtaacgtttaggaacgttaggtccggtgttacccgtttaagttttacgacgtcgtacgtaactccgtaaagttttactacgtacgttcgaccctttagggttaacgtccggttacggggccgttaaacgngtacggttagatacgaacgtacgtagtgacgtccagtacacgtntacggttcacgttaccgtctaacccg

SEQ ID NO: 4809 - DNA, 685 bp, Homo sapiens
  misc_feature: GYAE6OF02JMWUW.39.31.C09.1.454.CMB.1.raw
  modified_base (335)..(335): a, c, t, g, unknown or other
  misc_feature (335)..(335): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggacgggcccacatcaactcgacacgtccagccaggagttacgtttacactaggtaccaaacgaaataacgtaatttaccgttcgtacgttcggtaccagtacgaacgaaaccgtaggaacacgtaccttacgtaagttcgactacttactttacgngggtcctaacgtccggtacccggggtacggtcccgggtaccctacggtaccgtacgttcgacgtccggacacgggtccggtacgtacgacgacgtagttactttcgaaccgttcgtaccactacgtacgacgtccgacgtccgagacccgtagtaaccgngtaaacgngttacgggacttacgtttacgtttaacgagtcggtacagttacgtagtttactaggcgttactcgtacgtgtttaaccgggtcgggaccgtacgtaatcgaagttacaccgtttaaagaacccggttgttggtacctctacggacccacggttctacggttctaacggttctaccggttccc

SEQ ID NO: 4810 - DNA, 692 bp, Homo sapiens
  misc_feature: GYAE6OF02G2YTC.39.31.C09.1.454.CMB.1.raw
  modified_base (555)..(555): a, c, t, g, unknown or other
  misc_feature (555)..(555): n is a, c, g, or t
  modified_base (564)..(564): a, c, t, g, unknown or other
  misc_feature (564)..(564): n is a, c, g, or t
  modified_base (623)..(623): a, c, t, g, unknown or other
  misc_feature (623)..(623): n is a, c, g, or t
  modified_base (664)..(664): a, c, t, g, unknown or other
  misc_feature (664)..(664): n is a, c, g, or t
tcagtcgcactagtcacgaccggtgctcgatttagacgtctcatcaaggaaggaaggggcagcaagatggtgttgcagacccaggtcttcatttctctgttgctctggatctcgtggtgccgtacggggacatcgtgatcgacccagtcctcagacctcccgtggctgtgtctcgtgggcgaggacgggcccacatacaactgacaagtccacgaccaggtagtttcgtttacacgtacggtaaccaaactaaagtaaacgtaatttaccttacgtcgttacggtaccagacaaacgaaaaccgaggtaacaccgtacccttaccgtaagttcgacttactaacgtttacgtggacctacgtacccggtaacccggggtaggttacccccggggttcctcgaacccgttaagttccgacggtccggacgtacgggttccggcgtagaacgtaacgtagttactttacgaccttcctacgaaccgtactccgaagcctcgtacccgtgaccgtacggtacctaaggagtagtcggtagttacttagtttacttacngtacaggtntaagttatagacgttcgtcctgtaacggttcgttcgggacccgggtaacacgtaacggngtacgtacgtaacgaaacgtgtaggtcgtacgtgtaacccngtacgttccgatttcctacgctttcccg

SEQ ID NO: 4811 - DNA, 713 bp, Homo sapiens
  misc_feature: GYAE6OF02GJXGX.39.31.C09.1.454.CMB.1.raw
  modified_base (359)..(359): a, c, t, g, unknown or other
  misc_feature (359)..(359): n is a, c, g, or t
  modified_base (395)..(395): a, c, t, g, unknown or other
  misc_feature (395)..(395): n is a, c, g, or t
  modified_base (480)..(480): a, c, t, g, unknown or other
  misc_feature (480)..(480): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacgggacatcgtgatcgacccagtcctccagacctcccgtggctgtgtctcgtgggcgaggacggcccacatacacgtgacaacgtccagctagatttacgttacacgtaggaccaaacgaaataagtaacgtttactcgtccgttaggaccagacaacgaaccaggacacgaccctacgtagttcgccttagtatttacgagggactcgtccggtaccgggcgttcccggtacccngaccgttacgtcgacgggtccgcgtacgggccggtntacggacgtaacgtagttaccgtttaccgacgttaccgaccgtaacctacgtccgaacggtcaaccgtccgtcgtacgccggtanaacggtaagtacgtgggtacgtacgttacgtttaacgtacgttcgagtacgtagttaacgtatttacgtaacgttcggtacgttaccgtacgttttaccggtaccgggttaaccggacgtaggtccggtaacggacgttacgtaaccggtaacggtaacgttacgtaccggtaccgttaccgtaccgtaacccttacgttaccgttccttaacggttccttaccgttaccccg

SEQ ID NO: 4812 - DNA, 747 bp, Homo sapiens
  misc_feature: GYAE6OF02HSUX7.39.31.C09.1.454.CMB.1.raw
  modified_base (132)..(132): a, c, t, g, unknown or other
  misc_feature (132)..(132): n is a, c, g, or t
  modified_base (362)..(362): a, c, t, g, unknown or other
  misc_feature (362)..(362): n is a, c, g, or t
  modified_base (705)..(705): a, c, t, g, unknown or other
  misc_feature (705)..(705): n is a, c, g, or t
tcagtcgcactagtcacgaccggtgctcgatttagacgtctcatcaaggaaggaaggggcagcaagatggtgttgcagacccaggtcgttcatttctcgtgttgctcgtgatctctggtgaccgtacggganatcgtagatcgaccctagtcctacgacgcctcccgtggtctgtcgtctcgtgggacgaggacggcccaacgtacgtactaacgtcgacgtaacgccgagaccgtaagtgtttacgtttaacgaccgtaggtaaccaaataaataacgtacttacgtcgtacgttcggaccagacgaacggtaacagaacgtcgtacctaccgtaagtcggtctaacgttaagtttacggnggtacctacgtacccgtaccgggtacggttaccccggtaccgtacggtaccgtagttaccggacggttccggacggtacgggtccggtacgtacgggtaaaccgtacgggtacttacgttttaccccaccggtttacgtaaccctaaccggtatacgtacgaacgtcgttaacgcggaccgtaggtacctacgggtagtacgttcggtaacggtaccgttaagttttaccgaacggttcgtacccgaaggtacgttaacgttataacggtagtaccgtactacgtacgttacggttaccggacgtaccggatacgtgtaagactacgtaacgtagttcgggancggtacgacacgtaccgtagtaccgtacgtactacttacccg

SEQ ID NO: 4813 - DNA, 766 bp, Homo sapiens
  misc_feature: GYAE6OF02HTDZL.39.31.C09.1.454.CMB.1.raw
  modified_base (146)..(146): a, c, t, g, unknown or other
  misc_feature (146)..(146): n is a, c, g, or t
  modified_base (188)..(189): a, c, t, g, unknown or other
  misc_feature (188)..(189): n is a, c, g, or t
  modified_base (342)..(342): a, c, t, g, unknown or other
  misc_feature (342)..(342): n is a, c, g, or t
  modified_base (420)..(420): a, c, t, g, unknown or other
  misc_feature (420)..(420): n is a, c, g, or t
  modified_base (521)..(521): a, c, t, g, unknown or other
  misc_feature (521)..(521): n is a, c, g, or t
tcagtcgcactagtcacgaccggtgctcgatttagacgtctcatcaaggaaggaagggcagcaagatggtgttgcagacccaggtcttcatttctctgttgctctggatctcgtggtgccgtacggggacagtcgtgatcgacccngtcctcagcctccgtgctgtgtctgtggcgagacggccaacnncaactgacaacgtccaggccaggtagttacgtttacgacgtacggtacaaacgaaagtaagaacttacgttcgacgtttaggaccacgacgaaacgaaacgagggtaacacggacccttaacgttaagttcgactacgttaagtttacccggnggtacaaccgttaccggtaacccggggtaaccggttcccgggttcccacgggttaacctacgttaccggaggtcccgnggtaaccgggtcgggtttaccaggtaacgaactacggttaacttttccgactttccgaactaccggattcgaagtccacgtcgacgccgaggacttagaanacgttaggcgttaacgttaattttaacgtcgttacgtacgagtaccgttagttaacggttaattaacgggtccttaacccgttacggtaacgttaccggttttacccggggacggggtaaaccaggtaacccggaggttaaccgaaccgttaacggtaaacggaaccggtttcggaacggggccttaacccggctaaccggttagtacccgttacgtttccggtttaccacccgtttacccccgg

SEQ ID NO: 4814 - DNA, 739 bp, Homo sapiens
  misc_feature: GYAE6OF02H8Y82.39.31.C09.1.454.CMB.1.raw
  modified_base (137)..(137): a, c, t, g, unknown or other
  misc_feature (137)..(137): n is a, c, g, or t
  modified_base (475)..(475): a, c, t, g, unknown or other
  misc_feature (475)..(475): n is a, c, g, or t
  modified_base (728)..(728): a, c, t, g, unknown or other
  misc_feature (728)..(728): n is a, c, g, or t
tcagtcgcactagtcacgaccggtgctcgatttagacgtctcatcaaggaaggaagggcagcaagatggtgttgcagacccaggtcttcatttctctgttgctctggatctcgtggtcgcctacgggactagtcgtnatcgaccctagtcctaccagacctcccgtggcttcgtgtctcgtagggcgacgacgggcctaccagtccaacgtcgacgaacgtcccaaggccaaggtacgtttcgtttaaaccacgtacggttacccaaacaaaagttaacgtaatttaccgttcgcgtttaggtaccagactaacggaaaccgacggaccacgtcccttacgtaagttcgccttagtactttacgtggactacgtaccgtaccggtacggtcccggtaccgtcgaccgtcgtaccgtacggaccggtcgacggtccggtacgtacgagactacgtacttttcacgtctccacgacncgtagccgtacgccgtcgacgacggtacgtagtaagttacgtcggtacgttacgttattttaactaccgttagtaacctacgaacgtttacgtaattacggttacgttaccgttaccgtggttaaccgtttaccgggttacgggtaacccgggtaacgtacggtaacgttcgggaacgttacgtaacggtaaccgttacggtaggtccgtagtaccgtactaccgttactacgttaccgtactttacccggtnttaacccccgg

SEQ ID NO: 4815 - DNA, 736 bp, Homo sapiens
  misc_feature: GYAE6OF02FUGKO.39.31.C09.1.454.CMB.1.raw
  modified_base (649)..(649): a, c, t, g, unknown or other
  misc_feature (649)..(649): n is a, c, g, or t
  modified_base (675)..(675): a, c, t, g, unknown or other
  misc_feature (675)..(675): n is a, c, g, or t
tcagtcgcactagtcacgaccggtgctcgatttagacgtctcatcaaggaaggaaggggcagcaagagtggtgttgcagacccaggtcttcgatttctctgttcgctctggatctctggtgccgtacgggacatcgtgatcgaccagtctccagacgtccgtgactgtgtactcgtgggcgagacggccacataccaacgtgactaacgtccacgtacgagtacgttacgtttaaccaccgtacggtaaccaaactaaagttaaactaagttaaccgttcggtccgttaccgaaccgtaagacgtaaacggaaaccgagaactacggtacctacgtaagttcgacgtactacgttacgtcggactaccgtaccggtacccggacgggtacccggtccgtacgaacgtacgtaccgtacggtccggacgacgggtcccggtatacggacaacgtacgttctttaaccacgttactaaccggaacttaccggtataccggactaacccggtatcggaacgtaacggtacgtaacgtaagtacggtacggttggaacctttacgttattaccggtagtacacgtagtaaaggttacttaacggtagtaccgttacgtaccgtagttaccggttaccgggacggtaacgtacncggtagtacgtaccgaacggtaaccncggtaggtaccgaccgttagacctacgtcttaccggtacgacctttactacccgtttaccc

SEQ ID NO: 4816 - DNA, 147 bp, Homo sapiens
  misc_feature: GYAE6OF01DHCB0.13.64.F09.1.454.CMB.1.raw
  modified_base (147)..(147): a, c, t, g, unknown or other
  misc_feature (147)..(147): n is a, c, g, or t
tcagtcacgtactacacgaccggtgctcgatttagcgcgtatacaagggacacgactggagattaaacgaactgtggctgcaccatctgtcttcatcttcccgccatctgatagtacgtgactgagcgggctggcaaggcgcatagn

SEQ ID NO: 4817 - DNA, 230 bp, Homo sapiens
  misc_feature: GYAE6OF01CY3GJ.13.64.F09.1.454.CMB.1.raw
  modified_base (227)..(230): a, c, t, g, unknown or other
  misc_feature (227)..(230): n is a, c, g, or t
tcagtcacgtactacacgaccggtgctcgatttagcgcgtatacaagggcatggacgtctggggccaagggactaccgttaccgtcgccgcagcctccaccaagggcccatcggtcttcccctggcgccctgctccaggagcacctccgagagcacagcggccctgggctgcctggtcaaggactacttcctagtacgtgactgagcgggctggcaaggcgcatagnnnn

SEQ ID NO: 4818 - DNA, 230 bp, Homo sapiens
  misc_feature: GYAE6OF01DSBCV.13.64.F09.1.454.CMB.1.raw
  modified_base (228)..(230): a, c, t, g, unknown or other
  misc_feature (228)..(230): n is a, c, g, or t
tcagtcacgtactacacgaccggtgctcgatttagcgcgtatacaagggcatggacgtctggggccaagggactaccgttaccgtcgccgcagcctccaccaagggcccatcggtcttccccctggcgccctgctccaggagcacctccgagagcacagcggccctgggctgcctggtcaaggactacttcctagtacgtgactgagcgggctggcaaggcgcatagnnn

SEQ ID NO: 4819 - DNA, 232 bp, Homo sapiens
  misc_feature: GYAE6OF02IWNPP.13.64.F09.1.454.CMB.1.raw
  modified_base (228)..(232): a, c, t, g, unknown or other
  misc_feature (228)..(232): n is a, c, g, or t
tcagtcacgtactacacgaccggtgctcgatttagcgcgtatacaagggcatggacgtctggggccaagggactaccgttaccgtcgccgcagcctccaccaagggcccatcggtcttccccctggcgccctgctccaggagcacctccgagagcacagcggccctgggctgcctggtcaaggactacttcctagtacgtgactgagcgggctggcaaggcgcatagnnnnn

SEQ ID NO: 4820 - DNA, 158 bp, Homo sapiens
  misc_feature: GYAE6OF01A9SZ1.48.72.G06.1.454.CMB.1.raw
  modified_base (134)..(158): a, c, t, g, unknown or other
  misc_feature (134)..(158): n is a, c, g, or t
tcagagtatacatacacgaccggtgctcgatttagctacgactgcaagggaaagggagaacttgacaaacttgatggtcttcatcttcccgcatctgatatgtatactctgaggcgggctggcaaggcgcatgnnnnnnnnnnnnnnnnnnnnnnnnn

SEQ ID NO: 4821 - DNA, 143 bp, Homo sapiens
  misc_feature: GYAE6OF02IL09O.48.72.G06.1.454.CMB.1.raw
  modified_base (135)..(143): a, c, t, g, unknown or other
  misc_feature (135)..(143): n is a, c, g, or t
tcagagtatacatacacgaccggtgctcgatttagctacgactgcaagggaaagggagaacttgacaaacttgatggtcttcatcttcccgccatctgatatgtatactctgagcgggctggcaaggcgcatagnnnnnnnnn

SEQ ID NO: 4822 - DNA, 155 bp, Homo sapiens
  misc_feature: GYAE6OF01ED7U1.2.78.H01.1.454.CMB.1.raw
  modified_base (154)..(155): a, c, t, g, unknown or other
  misc_feature (154)..(155): n is a, c, g, or t
tcagacgctcgacacacgaccggtgctcgatttagtgtgagtagtttgggtttgggaccaaggtagagatcaaacgaactgtggctgcaccatctgtcttcatcttcccgccatctgatgtcgagcgtctgagcgggctggcaaggcgcatagnn

SEQ ID NO: 4823 - DNA, 154 bp, Homo sapiens
  misc_feature: GYAE6OF01EXGVR.2.78.H01.1.454.CMB.1.raw
  modified_base (154)..(154): a, c, t, g, unknown or other
  misc_feature (154)..(154): n is a, c, g, or t
tcagacgctcgacacacgaccggtgctcgatttagtgtgagtagtttgggtttgggaccaaggtagagatcaaacgaactgtggctgcaccatctgtcttcatcttcccgccatctgatgtcgagcgtctgagcgggctggcaaggcgcatagn

SEQ ID NO: 4824 - DNA, 155 bp, Homo sapiens
  misc_feature: GYAE6OF01C6LQ1.2.78.H01.1.454.CMB.1.raw
  modified_base (155)..(155): a, c, t, g, unknown or other
  misc_feature (155)..(155): n is a, c, g, or t
tcagacgctcgacacacgaccggtgctcgatttagtgtgagtagtttgggtttgggaccaaggtagagatcaaacgaactgtggctgcaccatctgtcttcatcttcccgccatctgatgtcgagccgtctgagcgggctggcaaggcgcatagn

SEQ ID NO: 4825 - DNA, 160 bp, Homo sapiens
  misc_feature: GYAE6OF01DSHH3.2.78.H01.1.454.CMB.1.raw
  modified_base (158)..(160): a, c, t, g, unknown or other
  misc_feature (158)..(160): n is a, c, g, or t
tcagacgctcgacacacgaccggtgctcgatttagtgtgagtagtttgggtttgggaccaaggtagagatacaaacgaactgtggctgaccaccatctgtcttcatccttcccgccatctgatgtcgagcgtctgagcgggctggcaaggcgcatagnnn

SEQ ID NO: 4826 - DNA, 533 bp, Homo sapiens
  misc_feature: GYAE6OF01BSYWU.2.78.H01.1.454.CMB.1.raw
tcagacgctcgacacacgaccggtgctcgatttagtgtgagtagtttgggtttggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtgggtcccatcgaggttcagaggcagtggatctgggacagatttcactctcaccatcagcggcctgcagcctgaagattctgcaacttactattgtcagtagttctgtatttcctttcccgcgtctacggtttcggaccgtagggggtaccctaagggtagaggtacttacgaaaaccggtaacgttcggtacgggaccttggccacccgtaacg

SEQ ID NO: 4827 - DNA, 499 bp, Homo sapiens
  misc_feature: GYAE6OF01ARJDG.2.78.H01.1.454.CMB.1.raw
  modified_base (390)..(390): a, c, t, g, unknown or other
  misc_feature (390)..(390): n is a, c, g, or t
tcagacgctcgacacacgaccggtgctcgatttagtgtgagtagtttgggtttggggcaggagtcagacccagtcaggacacagcatggacatgagggtcccgctcagctcctggggctcctgctgctctggttcccaggttccagatgcgacatccagctgacccagtctccttctttcgtgtctgcgtctgtgagagacagacttactatcacttgtcgggcagtcaggatattagtaccaacttagcctggtatcagcagaagcctgggcgagcccctaaactcctgatctatggtgcatcaagtctgcaaagtgggtcccatcgaggttcagaggcagtggatctgggacagatttcactctcacatcagcgctgcagcctgaagnttctgcaacttactattgtcagtagttctgtattctttcccgcgtctacgtttggccctaggggaccctaagggtagaggactacgaaacgactgtagactgcactacg

SEQ ID NO: 4828 - DNA, 515 bp, Homo sapiens
  misc_feature: GYAE6OF01AIOEV.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattctgccaacttactattgtcagtagttctgtactttctttcccgcgtctaccgtttggaccctagggggaccctaagggtagaggactacgaaacgacgtggtggactcgcacgtac

SEQ ID NO: 4829 - DNA, 154 bp, Homo sapiens; identical to SEQ ID NO: 4823
  misc_feature: GYAE6OF01A1FOB.2.78.H01.1.454.CMB.1.raw
  modified_base (154)..(154): a, c, t, g, unknown or other
  misc_feature (154)..(154): n is a, c, g, or t

SEQ ID NO: 4830 - DNA, 512 bp, Homo sapiens
  misc_feature: GYAE6OF01BIKKS.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttacatcacttgtcgggcagtcaggatattagtaccaacttagcctggtatcagcagaagcctgggcgagcccctaaactcctgatctatggtgcatcaagtctgcaaagtgggtcccatcgaggttcagaggcagtggatcgtgggacagatttcactctcaccatcagcgcctgcagcctgaagattctgcaacttactattgtcagtagttctgtactttcttcccgcgtcctacggtttcggcccgtaggggacccaagggtagagactacgaaaacgacgtggtaggctggcaccgtacg

SEQ ID NO: 4831 - DNA, 564 bp, Homo sapiens
  misc_feature: GYAE6OF01ERO1U.2.78.H01.1.454.CMB.1.raw
  modified_base (226)..(226): a, c, t, g, unknown or other
  misc_feature (226)..(226): n is a, c, g, or t
  modified_base (281)..(281): a, c, t, g, unknown or other
  misc_feature (281)..(281): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggctccgaggtgccagatgtgacatcctgatgacccagtctccatcctccctgtctgcatctgtaggagacagagtcaccatcacttgccgggnaagtcagagcattagcagcttatttaaatggtatcagcaagaaaccagggaaacncccctaaactcctgatctatgttacatcctagtttgactaaaggtcggggtacccagttacgtaaagggttcaaggtcggacgtaggtgggaattcgtagggaactaggtactttcactctaccaccatacagcagtctcgactaaccgtgaagttatttacgactaacttactactagtacaacagtacgttacacgttaccccgtggaccgttcggaccgtaacgggaccaagggtagaaatacgaaacgacgtgacggtactacgaccacctatcgtacg

SEQ ID NO: 4832 - DNA, 502 bp, Homo sapiens
  misc_feature: GYAE6OF01BH3K4.2.78.H01.1.454.CMB.1.raw
  modified_base (186)..(186): a, c, t, g, unknown or other
  misc_feature (186)..(186): n is a, c, g, or t
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
  modified_base (403)..(403): a, c, t, g, unknown or other
  misc_feature (403)..(403): n is a, c, g, or t
  modified_base (447)..(447): a, c, t, g, unknown or other
  misc_feature (447)..(447): n is a, c, g, or t
  modified_base (473)..(473): a, c, t, g, unknown or other
  misc_feature (473)..(473): n is a, c, g, or t
tcagacgctcgacacacgaccggtgctcgatttagtgtgagtagtttgggtttgggggcaggagtcagacccacgtcaggacacagcagtggacatgacggtccccgctcagctcctggggctcctgctgctctggttcccaggttccagatgcgacatccagctgacccagtctccttctttcgngtctgcgtctgtgagagacagacttactatcacttgcgggcgagtcaggatattagtaccaattagcctggtatcagcagaagcctgggcgagcccctaaactcctgatctatggtncatcaagtctgcaaagtcgggtacccatcgaaggttcaagnggctagtggatctgggacagtatttcactctcaccatcagtcggctgcagcctgaagtnttctgcaacttactattgtcagtacgttctgtacttcttcccgnctacgtttgccgagggaccagggtanagatacaaagtactgtggactgcactacg

SEQ ID NO: 4833 - DNA, 541 bp, Homo sapiens
  misc_feature: GYAE6OF01C4WIV.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaattagcctggtatcagcagaagcctgggcgacgccccctaaactcctgatctatggtgcatcaagtctgacaaaggtcggggtacccatcgaggttcaggaggcagtggatcgtgggacagtatttcactctcaccatcagcgctgcagcctagagattctgactaacttactattgtcagtacgttctgtactttccgtttcccgcgtccgtaccggtttcggaccgtaacggggacccgtaaagggtagaagtaacgtaccgaaaacgtacgtggtaggactcgctaccgtac

SEQ ID NO: 4834 - DNA, 571 bp, Homo sapiens
  misc_feature: GYAE6OF01C10BZ.2.78.H01.1.454.CMB.1.raw
  modified_base (401)..(401): a, c, t, g, unknown or other
  misc_feature (401)..(401): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcagtcaggatattagtaccaattagcctggtatcagcagaagcctgggcgagcccctaaactcctgatctatggtgcatcaagtctgcaaaggtgggtcccagtcgagttcagaggcagtggatcgtgggacagtatttcactctcaccatcagcgctgcagcctagaagtattcngactaacttactattgtactagtacgtttctgtactttccgtttcccgcgtccgtaccggttttcgggacccggtagggggaacccgtaaagggtaacggtaacggtaaacgtaaccgtaaaaaccggtaaccgttacggtacgggaccttacggcctaacccgttaacg

SEQ ID NO: 4835 - DNA, 537 bp, Homo sapiens
  misc_feature: GYAE6OF01E55L7.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgacgaaaggtcggggtcccagtcgaggttcagaggcagtggatcgtgggacagtatttcactctcaccatcagcgctgcagcctgaatacttctagactaactttactagttgtctagtacgttctagtactttccttacccgcgtccgtacggtttcggccgaaggggtaccgaaggtaggaagtactacgaaacgaacgtggtacggactcgccaccgtacg

SEQ ID NO: 4836 - DNA, 565 bp, Homo sapiens
  misc_feature: GYAE6OF01D8KPZ.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttcttcgtgtctgcgtctgtgagagacagacttactatcacttggtcgggcgagtcaggtatattagtaccaacttagcctggtatcagcagaagcctgggcgacgcccctaaactcctgatctatggtgcatcaagtctgacaaaggtcgggtcccagtcgaggttcagaggcagtggatcgtgggacagtatttcactctacacatcagcggcctgcagcctagaagtcttctgacctaactttactatttgactagtacgttctgtactttccgttcccgcgtaccgtacggtttcgggacccggtaagggggtacccgtaaagggttagaacggtaacgtaacgaaaaccggacgttagggtacggtactacggcctaaccgtacg

SEQ ID NO: 4837 - DNA, 503 bp, Homo sapiens
  misc_feature: GYAE6OF01DYHOH.2.78.H01.1.454.CMB.1.raw
  modified_base (394)..(394): a, c, t, g, unknown or other
  misc_feature (394)..(394): n is a, c, g, or t
tcagacgctcgacacacgaccggtgctcgatttagtgtgagtagtttgggtttgggggcaggagtcagacccagtcaggacacagcatggacatgagggtcccgctcagctcctggggctcctgctgctctggttcccaggttccagatgcgacatccagctgacccagtctccttctttcgtgtctgcgtctgtgagagacagacttactatcacttgtcgggcagtcaggatattagtaccaattagcctggtatcagcagaagcctgggcgagcccctaaatcctgatctatggtgcatcaagtctgcaaagtgggtcccatcgaggttcagaggcagtggatctgggacagatttcactctcacatcagcggctgcagcctgaagattcngactaactttactattgtacagtagttctgtactttccttccgcgtctacggtttggccgtaggggacctaagggtagagatacgaaacgacgtgtacggctgcactag

SEQ ID NO: 4838 - DNA, 804 bp, Homo sapiens
  misc_feature: GYAE6OF01D5V1H.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctcgacccagttcctccttctttcgtgtctgcgtctgtgagagacagtacttactatctacttggtcgggcgtagtcgaggattagttacgtacctaagttacgcctggtatcgagcaagaacgccgtgggaccgaccgacccctaaactcctgtactactagtggtcgactatacaagtctacgacgtaaaggtcgggtaccctagtcggtaggttcgaaggaggcgtaggtggtacgtcggtagggaactaggttactttaccgacctttcctaccgtaacctacgttaccgacgggtacccgggtcccgttacggacccgtaacggtacccgttagggtaaacgttaccgtttcgtaccggtaacctttaaacccgttttaacttaacggtttcggttaaccgttaaggtttaccgtttaccgtttaggtttaacccgttttttccccggtttacccccggtcgggtttaacccggtttaacccggggtttttacccggggacccgggttaaaacggggggtaaacccgttaaaacgggggttaacgggaaacggttaaaccgttaaaacccgggtaaaaccggttaaacgggttcgggttacgggtaacccgttaccggaacccgtacccggtttaacg

SEQ ID NO: 4839 - DNA, 598 bp, Homo sapiens
  misc_feature: GYAE6OF01BFHOY.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagccgtgggcgacgacccctaaactcctgatctagtggtgcatcaagtctagacgaaaggtcgggtaccagtcgaggttcaggagcgaggtgatcgtgggacagtacttcactctacacctatcgagcgctgcacgcctagaatattctagacctaactttactagttcgtactaggttacgttcgttacgttaccttttcccgtttcccggacgtaccgttaccgggtttaccgggacccggtaacgggggtaacccgtaaaggggtaacgaaggtaaactaaccgtaaaacgtaacgttggtacggtaccgtacgaccctaccgtaacg

SEQ ID NO: 4840 - DNA, 550 bp, Homo sapiens
  misc_feature: GYAE6OF01DSAM2.2.78.H01.1.454.CMB.1.raw
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcggcgagtcaggatattagtaccaattagcctggtatcagcagaagccgtggcgagcccctaaactcctgatctatggtgcatcaagtctgacaaagtgggtccatcgaggttcagaggcagtggatcgtgggacagtatttcactctcaccatcagcggctgcngcctgaagtnttctgactaacttactatttgctagtcgttctgtactttcctttcccgcgtccgtacggtttggcccgtaaggggtaacccgaaagggttagaacggtaacgttaaccgaaaacggtaaccgttggtacggaccgttcgaccgtaacccttacg

SEQ ID NO: 4841 - DNA, 504 bp, Homo sapiens
  misc_feature: GYAE6OF01DKYN9.2.78.H01.1.454.CMB.1.raw
  modified_base (341)..(341): a, c, t, g, unknown or other
  misc_feature (341)..(341): n is a, c, g, or t
  modified_base (397)..(397): a, c, t, g, unknown or other
  misc_feature (397)..(397): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagnggcagtggatctgggacagatttcactctcaccatcagcggcctgcagcctgaagnttctgacaacttactattgcagtagttctgcttcttcccgcgtcaccggtttggccgaggggacccaagggtagaggatacgaaacgaactgtggctggcacccgta

SEQ ID NO: 4842 - DNA, 715 bp, Homo sapiens
  misc_feature: GYAE6OF01BNV8C.2.78.H01.1.454.CMB.1.raw
  modified_base (106)..(106): a, c, t, g, unknown or other
  misc_feature (106)..(106): n is a, c, g, or t
tcagacgctcgacacacgaccggtgctcgatttagtgtgagtagtttgggtttgggggcaggagttagacccagtcaggacacagcatggacatgagggtccccgntcagctcctggggctcctgctgctctggttcccaggttccagatgcgacatccagctgacccagtctccttctttcgtgtctgcgtctgtgagagacagacttactatcacgttgtcgggcagtcaggatattagtaccaattagcctggtatcagcagaagcctgggcacgtcccctaaatcctagatctatggtgcatcaagtctagacgaaaggtcggggtaccctaagtcggaaggttacgaaggtacgggacaggtcgggatacggttaggggaactaagggttacttttaccgaaccttccgtacctaacccgtaacgttaccgaacgggtcccgggcccttacggaccgtaacggtccccgttaaggtaaacggttactttaccggtacgtaaccttaacctttaacgttagtttacgttacgtaagttaacgtttcgttacgttaacccgttttcccgtttacccggaccggtaccgttaaccgggttttcggacccggtaaacggggtaaacccgtaaggggttaacggaaggtaacgttaaccggaaaaaccgtacgttacgggtacggtaccttacggacccaaccgttagttacccg

SEQ ID NO: 4843 - DNA, 586 bp, Homo sapiens
  misc_feature: GYAE6OF01AENJJ.2.78.H01.1.454.CMB.1.raw
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (408)..(408): a, c, t, g, unknown or other
  misc_feature (408)..(408): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttggtcgggcgagtcaggatattagtaccaacttagcctggtatcagcagaagcctgggcgacgccccctaaactcctgatctatggtgcatcaagtctgacaaagtcgggtcccatcgaggttcaggaggcagtggatcgtggganagatttcactcncacatcgagcgcctgcagcctagaagtattcngacctaacttcatttgacagtacgtttctagtacctttcctttccccggcgttaccgtacggtttacggaccccggtaagggggtaacccgtaaaaggggtacgtaaacggaacgttaaacccggaaaacggtaaccgtttacgggacggtacccgttacgcccgtaaaccgttaccg

SEQ ID NO: 4844 - DNA, 577 bp, Homo sapiens
  misc_feature: GYAE6OF01BWKFM.2.78.H01.1.454.CMB.1.raw
  modified_base (572)..(572): a, c, t, g, unknown or other
  misc_feature (572)..(572): n is a, c, g, or t
tcagacgctcgacacacgaccggtgctcgatttagtgtgagtagtttgggtttgggggcaggagtcagacccagtcaggacacagcatggacatgaggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcagcccctaaatcctgactctatggtgcatcaagtctgcaaagtgggtaccactcgtacggtcgtagagggacgagtggtagtcgtcgggacgtacgtagtttacttactacttacctaccactacgtacgcgggtcccgtcgtcgacgtaccgtcgaaggtaacttcgttacgtacctaactttaaccttattacgtcctaagtacgtttcgttgtactttcgtttcccgtcgtcgtaccgttcggtccgacgggtacggtaacgtaggagatacgaaacgaacgtcgtgcgtcgcncgtac

SEQ ID NO: 4845 - DNA, 535 bp, Homo sapiens
  misc_feature: GYAE6OF01CQJMG.2.78.H01.1.454.CMB.1.raw
  modified_base (404)..(404): a, c, t, g, unknown or other
  misc_feature (404)..(404): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggacagtcaggatattagtaccaattagcctaggtatcagcagaagcctgggcgagcccctaaactcctgactctatgtgcatcaagtctagactaaaggtcgggtccagtcgaggtcagagcagtggatcgtcgggacagtacttcactctacacatcgagcgcctgcagcctagaagtntcacgactaacttactattgtacagtagttctgtacttccgttccgcgtctacggttcggaccgtacgggaacgtaaggtagaagtacgtaccgaaaacggacgttcggtacggtactacgctacccgtag

SEQ ID NO: 4846 - DNA, 542 bp, Homo sapiens
  misc_feature: GYAE6OF01ESUHB.2.78.H01.1.454.CMB.1.raw
  modified_base (404)..(404): a, c, t, g, unknown or other
  misc_feature (404)..(404): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtcggggtcccagtcgaggttcagaggcagtggatcgtgggacagtatttcactctcaccatcagcgcctgcagcctgaagattcngacctaacttactattgtctagtagttctgtactttccgtttcccgcgtccgtacggtttcggacccgtaggggaacccgtaagggtagaacggtaactaccgaaaacgtacgttggtcggacttcggccaccgtacg

SEQ ID NO: 4847 - DNA, 528 bp, Homo sapiens
  misc_feature: GYAE6OF01CNQZM.2.78.H01.1.454.CMB.1.raw
  modified_base (303)..(303): a, c, t, g, unknown or other
  misc_feature (303)..(303): n is a, c, g, or t
  modified_base (397)..(397): a, c, t, g, unknown or other
  misc_feature (397)..(397): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcggcgagtcaggatattagaccaattagcctggtatcagcaagaagccgtgggcgacgcccctaaactcctgatctatggtncatcaagtctgacaaagtcgggtccagtcgagttcagagcagtgatcgtgggacagtattcactctcacatcagcggctgcagctgaagtatcngactaacgttactattgtacagtagtttctgttacttccttccgcgtcgtacgttcggaccgtacgggaccgtaagggtagagtaacgtaccaaacggaaccgttggtacggtcttacgaccgtacgtacg

SEQ ID NO: 4848 - DNA, 544 bp, Homo sapiens
  misc_feature: GYAE6OF01COUFX.2.78.H01.1.454.CMB.1.raw
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaattagcctggtatcagcagaagcctgggcgacgcccctaaactcctgatctatggtncatcaagtctgacgaaagtcggggtcccagtcgaggttcagaggcagtggatcgngggacagtatttcactctcaccatcagcgcctgcagcctagaagtcttctgactaaacttatagttacgtcaaggtacgtttctgttactttcctttcccggctccgtacggtttcgggacccgtaggggaaccgaagggtagaaggtactaccgaaaacgtactggtcgactcgcctaccgtacg

SEQ ID NO: 4849 - DNA, 542 bp, Homo sapiens
  misc_feature: GYAE6OF01BX32D.2.78.H01.1.454.CMB.1.raw
tcagacgctcgacacacgaccggtgctcgatttagtgtgagtagtttgggtttgggggcaggagtcagacccagtcaggacacagcatggacatgaggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaattagcctggtatcagcagaagcctgggcgacgcccctaaactcctgatctatggtgcatcaagtctgacaaagtcggggtcccagtcgaggttcaggaggcagtggatcgtgggacagtattcactctcacatcagcgctgcagcctagaatattctagtaactttatattgtacagtagttctgtactttccgtttcccgcgtacctacggtttcggaccgtacggggtaacccgaagggtacgaagtacgtacgaaaacgtaacgtggtcggactacgacctaccgtgttaccg

SEQ ID NO: 4850 - DNA, 695 bp, Homo sapiens
  misc_feature: GYAE6OF01D8I2P.2.78.H01.1.454.CMB.1.raw
  modified_base (330)..(330): a, c, t, g, unknown or other
  misc_feature (330)..(330): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagtacttactatcacgttggtcgggcgagtcaggtattattacgtaacctaattacgccgtaggtactcgagcaaggaacgccgtagggaccgacgacccccttaaactccgtagatcgtagtggtnctatctaagtctgacgaaaggtcgggtacccagtacggtaggttcgaaggacggacgtaggtggacgttacggtagggaactaaggttactttaccgaccttcctaccaccgtactaccggacggcccggtacccgtcggaccgtaccggtaccgtaaggtaacttcttccgtacgtaccttaaactttacttagttcgacgttagttacgtttaccgttacgtttaccgtttcccgtttacccggaccggttaccgttaccgggttacggcccgggtaaacggggttacccgtaaagggttacggaacgtaaccgtaacgtaaaccggtacgttcgggacggtaccgttacgcctaccgttacg

SEQ ID NO: 4851 - DNA, 547 bp, Homo sapiens
  misc_feature: GYAE6OF01ASR50.2.78.H01.1.454.CMB.1.raw
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
  modified_base (437)..(437): a, c, t, g, unknown or other
  misc_feature (437)..(437): n is a, c, g, or t
  modified_base (536)..(536): a, c, t, g, unknown or other
  misc_feature (536)..(536): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttggtcgggcagtcaggtatattagtaccaacttagcctggtatcagcagaagcctgggcgacgcccctaaaactcctgatctatggtgcatcaagtctgacgaaaggtggggtcccatcggaggttcaggaggcaggtggatcgtggganagtatttacacttcncacatcagcggcctgacacgctagaactattctcgactaacttactattcgtanagtagttctgtactttccgttcccgcgtcctcggttcgccggtaacgggggtaaccaagggtagaggtacgtaaccgaaacggacttcggtacggtacncgactcctacg

SEQ ID NO: 4852 - DNA, 625 bp, Homo sapiens
  misc_feature: GYAE6OF01EIS35.2.78.H01.1.454.CMB.1.raw
  modified_base (463)..(463): a, c, t, g, unknown or other
  misc_feature (463)..(463): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtcctccttctttcgtgtctgcgtctgtgagagacagtacttactatcacttgtcgggcgagtcgaggtattattacgtacctaacttagcctggtatcagcagaacgccgtgggcgacgaccccctaactcctgactcgtagtggtcactatacgtaacgtcgtacgacgtaaagggtcgggtacccagtcggtaggttcaaggacgacgaggtggactcggtagggactagtactttccacttctaccactagtacgacggtccgcctgacgacgtccgtagtaagtcttcncgtaccttaacttacttagttcgtacgtagtacgttcgtagttacctttcccgttcccgacgttaccgtaccggtttcggacccggtacgggtaaccgtaagggtagaacggtactaaccgtaaacgtacggttacggtacggactaccggtccacgttacg

SEQ ID NO: 4853 - DNA, 621 bp, Homo sapiens
  misc_feature: GYAE6OF01B9XXW.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttggtcgggcagtcaggatattagtaccaattagcctggtatcagcagaagcctgggcgacgcccctaaactcctgactctatggtgctatcaagtctagacgaaaggtcggggtcccagtcggaggttcaggaggcgaggtggactcgtagggacaggtactttcgacttctaccgacctatcgacggccggccttagcctacgtcctagaactactttcgtacgtacctaactttacttacgttcgtactaaggttacgtttacgttacgtacttttcccgtttaccccggcgttaccgttacgggttttaccgggacccgtaaacgggggaccctaaaggggttagaacggtagtaacccgaaaacggtacttagggtacggacctacgcctaaccgtacg

SEQ ID NO: 4854 - DNA, 658 bp, Homo sapiens
  misc_feature: GYAE6OF01BR050.2.78.H01.1.454.CMB.1.raw
  modified_base (169)..(169): a, c, t, g, unknown or other
  misc_feature (169)..(169): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccngtctccttctttcgtgtctgcgtctgtgagagacagtacttactatcacgttgtcgggcagtcaggtattattagtaccaattagcctggtatcagcaagaagccgtgggaccgacgaccccctaaaactcctagactctatggtgcatacaagttctagacgtaaaggtcggggtacccagtcggaggttcgaaggaggcaggtaggtatcggtgggactagtactttaccgacttctacacctatcgacggcggcctgcacgcccgtagaacgtacgttcgtacgaccttaaactttacttaagtttacgtactaaggttacgtttccgttacggttaccttttccgtttccccggtacgtaccggttacggttttaccgggaacccggtaacggggtaacccgtaaagggtacggtaacggtaaacgtaaccggtaaaaccggtaacgttcgggttacggtaccgtacgtaccgaacccttaacgg

SEQ ID NO: 4855 - DNA, 541 bp, Homo sapiens
  misc_feature: GYAE6OF01B84HI.2.78.H01.1.454.CMB.1.raw
  modified_base (403)..(403): a, c, t, g, unknown or other
  misc_feature (403)..(403): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttcttcgtgtctgcgtctgtgagagacagacttactatcacttgtcgggcgagtcaggatattagtaccaattagcctggtatcagcagaagcctgggcgagccccctaaactcctgatctatggtgcatcaagtctgcaaaggtcgggtcccagtcgagttcaggaggcagtggatcgtgggacagtatttcgactctcaccatcagtcggcctgcagcctgaagtnttctgacctaactttactattcgtacagtgttctgtacttttccgttacccgcgtctacgtttcggacccgaaggggtacccgtaagggtaggacgtaactaccgaaaacgtacgtggtcgactcggaccaccgtacg

SEQ ID NO: 4856 - DNA, 616 bp, Homo sapiens
  misc_feature: GYAE6OF01ATKNM.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagtacttactatcacttggtcgggcgagtcaggatagttagtaccaacttagcctggtatcagcagaagccgtgggcgacgcccctaaactcctagatctatggtgacatacaagtctagacgaaaggtcggggtacccagtcggaggttcgaggacggcgaggtggtatcgtacggggactaaggtactttcaccttcctaccacctactcgacggccgccgtggaccacgcctaggaacgtattcctagacctaactttactagttcgtactagttacgtttcttggttacctttcccgtttaccccggcgtaccgttacgggtttaccgggacccggtaacggggtacccgtaagggtacggaacgtaacgttaaccgaaacgacgttggtacggactcgccgtacctcg

SEQ ID NO: 4857 - DNA, 929 bp, Homo sapiens
  misc_feature: GYAE6OF01DPNRG.2.78.H01.1.454.CMB.1.raw
tcagacgctcgacacacgaccggtgctcgatttagtgtgagtagtttgggtttgggggcaggagtcagacccagtcaggacacagcatggacatggacgggtccccgctcagctcctggggctcctgctgctctggttcccaggttccagatgcgacatccagctgacccagtctccttctttcgtgtctgcgtctgtgagagactagtaccttaactactcctacgttgggtccggggacgtaggttccgaagggtaatttaacgtttaacgtaacccctaaacgttttacgacccgttagggttaactcgaaggaccaaggtaaaccggtcccggttacggggaccccgtaacccggtaaccccccctttaaaaaccgtcccgtacggtaaactttccgtaaggttagggttcgaactaacgtaccgttaaaacggtttccgtaacggtaaccggaaaacggggtttccggggtacccctaacggttcggtaaacgggtttacgaagggacggtacgtaaaggtcggtaacgttcggtaacggggtaactaacggtttaccttttaccgaaccctttaccgtaaccctaacccgtaacgtacccgtaacgggtacccggtccccgttacggacccgtaaccggttaccggtaacgggtaaactttccgtttaacccgttaacgaacccttttaaaccgttttaacgttaagtttaccgttacgtaacgttacgttttaccgttacgtttaacccgttttccccgttacccggtaccggttacccggtttacccgggtttaccggggaaacccgggttaacggggtaaaccccggttaaacgggttaaccggaaacggttaccgttaaaaccggtaaaaccggtacggttacgggtaccggtacgttaccgtaaccctaccggttacg

SEQ ID NO: 4858 - DNA, 655 bp, Homo sapiens
  misc_feature: GYAE6OF01EW1F6.2.78.H01.1.454.CMB.1.raw
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (606)..(606): a, c, t, g, unknown or other
  misc_feature (606)..(606): n is a, c, g, or t
tcagacgctcgacacacgaccggtgctcgatttagtgtgagtagtttgggtttgggggcaggagtcagacccagtcaggacacagcatggacatgagggtccccgctcagctcctgggctcctgctgctctggttcccaggttccagatgcgacatccagctgacccagtctccttctttcgtgtctgcgtctgtgagagacagacttactatcacttggtcgggcgagtcaggtatagtacactagtcncgtgtacngacagagacgtcggacggacgaccccgtaaccctaacctcgtagtacttacgtaggtcggtacactacgtaacgtacgtcggtacgtaaacggtaacgggggttcccgtaccgtacgtacgggttacgtacggaagggtacggacggtaggtagtccgtgggtaacggatagtttacctaccgtactcctaccgaactcgtacgacgggtccgtacgcgacggtcctagtaaggactttctcgtactaaaccttactttacgtgtcgtaagtaagttcttgtactttccgtttccccgccggtacgtaccggtttcgggtcgaacccggggataaaccgggtaggtanacggttaaccaaacggtaacgtcgtcgggtactccggcaacctcgttcg

SEQ ID NO: 4859 - DNA, 513 bp, Homo sapiens
  misc_feature: GYAE6OF01AUQD4.2.78.H01.1.454.CMB.1.raw
  modified_base (337)..(337): a, c, t, g, unknown or other
  misc_feature (337)..(337): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (507)..(507): a, c, t, g, unknown or other
  misc_feature (507)..(507): n is a, c, g, or t
tcagacgctcgacacacgaccggtgctcgatttagtgtgagtagtttgggtttgggggcaggagtcagacccagtcaggacacagcatggacatgagggtcccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtgggtccatcgagttcagnggcagtggatcgtgggacagactttcactctcaccatcgagcggctgcagcctgaacgnttcngctaacttactattgtcagtacgttctgtacttcttcccgcgtaccgtacggtttggccgaggggaccaagggtagaggtctacgaaacgtacgtgtacggctcgcncgtacg

SEQ ID NO: 4860 - DNA, 621 bp, Homo sapiens
  misc_feature: GYAE6OF01A4C7C.2.78.H01.1.454.CMB.1.raw
  modified_base (177)..(177): a, c, t, g, unknown or other
  misc_feature (177)..(177): n is a, c, g, or t
  modified_base (297)..(297): a, c, t, g, unknown or other
  misc_feature (297)..(297): n is a, c, g, or t
tcagacgctcgacacacgaccggtgctcgatttagtgtgagtagtttgggtttgggggcaggagtcagacccagtcaggacacagcatggacatgagggtccccgctcagctcctgggctcctgctgctctggttcccaggttccagatgcgacatccagctgacccagtctccttntttcgtgtctgcgtctgtgagagacagtacttactatctacgttgtcgggcgagtcaggtattattagtaccaattagcctggtatcagcagaagcctgggcgacgacccctaaactccngatctatggtgcatcaagtctagacaaaggtcgggtacccagtcggtaggttcaggagcgaggtggactcgtgggactaggtactttcgacttcgtacacctagtccgacgcggtaccctgaccgtacgtacccgtagaacgttcttccgtacgaaccttaactttacgttacgtttcgtacgtaacgttcgtttcgttacgttacctttccgtttacccggcgtcccgttacgggtttccgaccggaacggggtaccgtaaagggtagaacggtaactaccgtaaaacggtacgtcggtacggacccacgtaccacgttaccg

SEQ ID NO: 4861 - DNA, 500 bp, Homo sapiens
  misc_feature: GYAE6OF01AC2HO.2.78.H01.1.454.CMB.1.raw
  modified_base (178)..(178): a, c, t, g, unknown or other
  misc_feature (178)..(178): n is a, c, g, or t
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttnttcgtgtctgcgtctgtgagagacagacttactatcacttgtcgggcagtcaggatattagtaccaacttagcctggtatcagcagaagcctgggcgagcccctaaactcctgatctatggtgcatcaagtctgcaaagtggggtcccagtcgaggttcagaggcagtggatcgtgggacagtatttcactctcaccatcagcgctgcagcagatcttcngactaacttactattgnagtnttctgtattcttcccgcgtctacgttggaccgagggacctaaggtagagactacgaaacgacgtgtacgctcgcacctacg

SEQ ID NO: 4862 - DNA, 778 bp, Homo sapiens
  misc_feature: GYAE6OF01DJAJK.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcagtcaggatatagtaccaattagcctggtatcagcagaagccgtgggcgacgaccccctaaactcctgatctagtggtcgcaatcgtaaagtctagacgtaaaagggtcggggtaccaagtcggtaaggttacgaaggacggctaggtggactcggtaggggaactaaggttacttttaccaaccgtttcctacctaacccgtacgttaccgaacgggtccccgggtacccgttcggaccgtaacggtaccccgttaagggaaaccgtttacgtttaccgtaacggttaacccttttaaaaccgtttaaccgtttaagttttacggttaaccgttaacgggtttaacgttttaccgttaggtttaaccctttttccccgttttacccccgggtcgtttaacccgttaacccgggggtttttacgggaaccccgggtaaacgggggggtaaacccctaaaagggggttaacgaaacggttaaaccgtaaaccggtaaaaaccggttaacgttacgggttacgggacccttacgggaaccctaaccggttaacg

SEQ ID NO: 4863 - DNA, 585 bp, Homo sapiens
  misc_feature: GYAE6OF01DK947.2.78.H01.1.454.CMB.1.raw
  modified_base (499)..(499): a, c, t, g, unknown or other
  misc_feature (499)..(499): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttccccaggttccagatgcgacatccagctgacccagtcctccttctttcgtgtctgcgtctgtgagagacagtacttactatctacgttggtcgggcagtcaggtatattagtaccaattacgcctaggtatcagcaagaagccgtgggccgaccgtaccccctaaactcctagatcgtagtggtcacatcaagtctgacgtaaaggtcgggtacccagtacggaggttacgaggacgcgtagtcgggtatcggtagggactagtacttcacttcctacacctactcgacgccggctgacacgcctagacgtactctacgtactaacttactattgactagttgttctgtacctttccgtccgngtccgttacggttacggccggaagggtaccgaggtaagacgtacgtaacgaaacgtacgttgggtacgactacggccctacgtacg

SEQ ID NO: 4864 - DNA, 814 bp, Homo sapiens
  misc_feature: GYAE6OF01AP081.2.78.H01.1.454.CMB.1.raw
tcagacgctcgacacacgaccggtgctcgatttagtgtgagtagtttgggtttgggggcaggagtcagacccagtcaggacacagcatggacatgagggtcccgctcagctccgtgggctcctgctgctctggttcccaggttccagatgcgacatccagctcgaccctagtccttccttctttcgtgtctgcgtctgtagagagacagtaccttactatctacgttggtccgggcgagtcgaggtattagttacgaacctaattgcctggtactcagcaagacgccgtgggaccaccgtacccctaactcctagtactcgtagtggtacgactagtacgtagtctaggacgtaaacgggttcgggtaccagtcggtagtagaggacggtcgtaggtcggtacgtcggtacgggactaggttaccttaccacttaccgtaccaaccgttacgtaccgaccgggtcccggttacccgacgggtaccgtaccggttaaccgttaacggttaaacgggtttaccttacccggttaaacggttaaccccttttaaaacgtttttacggttaacgggtttaaccggtttaaccgttaacgggttttaaccgtttccgtttttaaaccggtttacccgtttttaccccggttaccccggtacccggtttaacccggttcgggggtttaacccgggaaccgggggtaaaccgggttaacccggtaaaggggttaccgtaaacggtaccgttaaaacgggtaaaccccgttggttaaaccggggttcccgaaacgttcccgtaaacccgtacggtttaccgg

SEQ ID NO: 4865 - DNA, 787 bp, Homo sapiens
  misc_feature: GYAE6OF01AU3PC.2.78.H01.1.454.CMB.1.raw
  modified_base (770)..(770): a, c, t, g, unknown or other
  misc_feature (770)..(770): n is a, c, g, or t
tcagacgctcgacacacgaccggtgctcgatttagtgtgagtagtttgggtttgggggcgaggagtcagacccagtcaggacacagcatggacatgaggtccccgctcagctcctgggctcctgctgctctggttcccaggttccagatgcgacatccagctgacccagtcctccttcttcgtgtctgcgtctgtgagtagacagacttacatctacttggtacggcagtcaagggtattagttacgtaacctaacgttacgtccgttaggtaactaccgaacgtaccgaaggtaaaccggtcccggttacggggaccggtaacccgtaccccccgttaaaaaccgttcccgtaggtaaccgttaccgttaaggtcgggttacgactaacgttaccgtaaacgttacctcggtaaaccggtaaaacgggttccgggggtacccctaagttaccggtaaggttaccgaagggagggtccgtaaggtcggtacgtccgggtagggaaacttaggtaactttacccacgtactaccgtacctaagtccgacggtccggtacccttggacctacggtacccgttaagtaaacggttctttacccgagtaacccttaatttacgttacgtttcgaaccgtacggtttacgtttccgttaggtttaaccctttcccgtttaaccccggccgttacgttaccggttcgggtacccggtaaacgggtaccgaacgggttaagaccgtagtaaccgtaaacgggtacttggtaccgggntacgtaccgtccgtaag

SEQ ID NO: 4866 - DNA, 628 bp, Homo sapiens
  misc_feature: GYAE6OF01BYKHV.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtcctccttctttcgtgtctgcgtctgtgagagacagacttactatcacttggtcgggcagtcaggatattagtaccaacttagcctggtatcgagcagaagccgtgggcgacgaccccctaaactcctgtactctatggtgcatcaagtctgacgaaaggtcgggtacccagtccggaggttcgaggaggcgaggtggatcgtgggactagtactttaccactacctccaacctatccgacggccggtcctggcaacgtccgtagaacgttattccgtagtacctaaactttacttatttcgtacgtaggttacgtttcgtagttacttttcccgttcccgccgtaccgtttacgggtttcggacccgggtaaggggtaacccgtaagggttacgaacggtaacttaaccgaaaacgtaacgttcggtacggtaccgttacggacctacccgttaacg

SEQ ID NO: 4867 - DNA, 683 bp, Homo sapiens
  misc_feature: GYAE6OF01A54HG.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattaacgtacctaacttagcctggtatcgagcaagaacgccgtgggaccgacgaccccctaaactccgtgacttacgtagtggtgctactacgaagtcctaggaccgtaaagggtccgggtacccaggttcggtaaggttacaaggacggcgtaaggttaggattcggacgggtaactaggttaactttccaccgttacctaccgacctactccgacgtcccgggtacctaggaccctacggtccctaaggtaaacgttcctttaccgacgtaaccctttaaacgtttactttaagttcgtaacctaaggttacgtttcttacgttaccttttcccgtttcccggacgttaccgttacgggtttccggaccggtaacggggtaacctaagggtagacgtaacgtaaaccgtaaacgtacgtgggtacgactacggacctaccgtacg

SEQ ID NO: 4868 - DNA, 681 bp, Homo sapiens
  misc_feature: GYAE6OF01DWIFK.2.78.H01.1.454.CMB.1.raw
  modified_base (180)..(180): a, c, t, g, unknown or other
  misc_feature (180)..(180): n is a, c, g, or t
  modified_base (520)..(520): a, c, t, g, unknown or other
  misc_feature (520)..(520): n is a, c, g, or t
tcagacgctcgacacacgaccggtgctcgatttagtgtgagtagtttgggtttgggggcaggagtcagacccagtcaggacacagcatggacatgagggtccccgctcagctccgtggggctcctgctgctctggttcccaggttccagatgcgacatccagctgacccagtctcctttntttcgtgtctgcgtctgtgagagacagtacttactatcacgtttggcggacgagttcgaaggtaattagttaacgtaacctaacgtttacgccgttaggtaactcgaacgacgaaggtaaacgtccgtacggggaccgtaaaccgtaccccccttaaaactccgttagactttacctagttggtcgactataccgtaagtctacggtaacgaacggttcgggtaccagtacggtacggttagaggtaggcgtaagtggtacttcggtagggaactaggttactttactacctctaccacctaacgtcgagtcccggcgtcgcgacgtcgtaagtaacgtnttctacgttaacctaacgtttacttagttacgtctaaggttcgtttactacgtttaccttcccgttccggtacgtaccgttacgggttacggaccggtaagggaaccgtaagggactaaggacttaaaccgaaacgtacgtggtatcttacgccctagtac

SEQ ID NO: 4869 - DNA, 576 bp, Homo sapiens
  misc_feature: GYAE6OF01ARQIW.2.78.H01.1.454.CMB.1.raw
  modified_base (392)..(392): a, c, t, g, unknown or other
  misc_feature (392)..(392): n is a, c, g, or t
  modified_base (474)..(474): a, c, t, g, unknown or other
  misc_feature (474)..(474): n is a, c, g, or t
tcagacgctcgacacacgaccggtgctcgatttagtgtgagtagtttgggtttgggggcaggagtcagacccagtcaggacacagcatggacatgagggtcccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaattagcctggtatcagcagaagcctgggccgaggcccctaaactcctacgatcctatggtgcatacaacgtctagacaaaggtcggggtacccagtacggaggttcaggaggctaggtggatcgtagggacagtattcactctcacntcagcgctgcagcctagagtacttcgagacttaacttactagtttcgtctaagttcgttattcgtactttcccgtttcccgngtccctacggtttcgggacccgtacgggggtaacaacgggttaggaacggtacgttaacgaaaaccggacgttcggtacggtctaccggccaaccggttacc

SEQ ID NO: 4870 - DNA, 742 bp, Homo sapiens
  misc_feature: GYAE6OF01DF1MA.2.78.H01.1.454.CMB.1.raw
  modified_base (336)..(336): a, c, t, g, unknown or other
  misc_feature (336)..(336): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttcttcgtgtctgcgtctgtgagagacagacttactatctacgttggtcgggcgagtcaggtataattacgtaccaacttagcctaggtactcgagacaaggaagccgtgggaccgaccgaccccccttaaaactcccgtagtacttccgttagtgggtanacgtaataccgaaagttcctacggaccgtaaagggtccggggtacccaagttcggtaagggttacgaagggtaggaccgtaggtgggtacttacggtaggggaactaggttaacttttccaaccgttcctaacccgacctaacgttccgacgggtacccggtcccgttacgaccgtaacggtaccccgttaagggtaaacgtaccgttttaccgtaccggttaaaccttttaaaccgtttacgtttaacgtttcggttaaccgtaaggttaaccgtttcgtacgtttaccgtttcccgttaccccggtccgtaaccggtttccggttacggacccggtaacggggtaacctaaagggtagacgtaacgtaaccgaaacggtgttacggtagctacggcctacgtac

SEQ ID NO: 4871 - DNA, 624 bp, Homo sapiens
  misc_feature: GYAE6OF01EJOXX.2.78.H01.1.454.CMB.1.raw
tcagacgctcgacacacgaccggtgctcgatttagtgtgagtagtttgggtttgggggcaggagtcagacccagtcaggacacagcatggacatgaggtccccgctcagctcctggggctcctgctgctctggttcccaggttccagatgcgacatccagctgacccagtcctccttcttcgtgtctgcgtctgtgagagacagtacttactatctacgttggtcgggcgagtcgaaggtattagttacgtacctaacttagcctggtatcagcagaagccgtagggcgacgacccctaaactcctagactctagtggtgctatcaagtctagactaaggtcgggtccagtacgagttcgagaggctaggtgatcgtaggactagtacttcactctacacctagtcacggtccgtctgaccagtacctaggaactcttactcgaacctaactttacagtttcacgtagtacgtttcgtacgttacgtttcccttcccggtagtcccgtacggtttccggaccggttaaacggggaaccgttaaagggtacgtaaccggttactaaacccggtaaaaccggtaccggttacggtcgggtaccgttacgacccgttaccgttaccg

SEQ ID NO: 4872 - DNA, 650 bp, Homo sapiens
  misc_feature: GYAE6OF01DM7NN.2.78.H01.1.454.CMB.1.raw
  modified_base (311)..(311): a, c, t, g, unknown or other
  misc_feature (311)..(311): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacgttggcgggcgagtcaggtattattagtaccaattagccttggtatcagcagaagccgtgggcgacgacccctaaactcctagatctagtggtncatacaagtctagacgaaaggtcgggtaccagtcgaggttcagagcgaggtgatcgtaggactagtactttcacttctacacatccgagccgctgaccacgtccgtagaacgtacttcgtacgtaccttaaacgtttacttagtttacgtacgtagttacgtttcgttacgttaccgtttccccgtttacccggccggttacccgtttaccgggttttaccgggacccgggtaaacggggggtaaacccgttaaaggggtaacgtaacggtaaaccgttaaaccgtaaaaccggttaacgttcgggtacggtaccgttacggaccctaaccgttaaccg

SEQ ID NO: 4873 - DNA, 640 bp, Homo sapiens
  misc_feature: GYAE6OF01CU5QD.2.78.H01.1.454.CMB.1.raw
  modified_base (311)..(311): a, c, t, g, unknown or other
  misc_feature (311)..(311): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttccccaggttccagatgcgacatccagctgacccagtctccttctttcgtgtctgcgtctgtgagagacagtacttactatctacttggtcgggcagtcaggatattagtaccaattagcctggtatcagcagaagccgtgggaccgacgcccctaactcctagattctagtggtnctactacaagtctagacgtaaaggtcgggtaccagtcggtaggttacagaggacaggtggatcgtgggaacagtactttccacttctaccacctactcgacgccggtacctcgacctacggccgtagtaacgttacttacctacgtaaccttaactttacttagtttacgttaccgtaagttacggtttcttacgttacgttttcccgtttacccggtcgtaccgtaccgggtttcggacccgggtaacggggtaaccgtaaaggtaggaacgtaaccgtaaccgtaaaacgtaccgttacggtacggtagtcccgccgtaaccgtacg

SEQ ID NO: 4874 - DNA, 765 bp, Homo sapiens
  misc_feature: GYAE6OF01AZX27.2.78.H01.1.454.CMB.1.raw
  modified_base (186)..(186): a, c, t, g, unknown or other
  misc_feature (186)..(186): n is a, c, g, or t
tcagacgctcgacacacgaccggtgctcgatttagtgtgagtagtttgggtttgggggcaggagtcagacccagtcaggacacagcatggacatgaggtccccgctcagctccgtgggctcctgctgctctcggttcccaggttccagatgcgacatccagcctagaccctgtccttcttcttcgngtctgcgtctgtagagacgacagtacttacgtatcctacgtttcggtacggggacgtagtacgaaggtatttaacgtttaacgtaaccctaagtttacgccgttaggtactacgacgaccgaacggtaaacgtccggtaggggacccgtaccgtaaccccccgttaaacctccttaggtacttacgtagttgggtcgtacctaacgtacctaagttccgtaggtaaaccggtaaaacgggttccgggtacccctaaggtaccggttaacgggttaccgaagggtaccgggaccgtaaggtcgggtaacgttcgggtacgggaacgttacgttacgttttaccgaactttcctacctaacgtaccgttaacggccggtaccggtcctacggaccgtacgtaccgtaggaacgttacgttcctacggtactaacctttagttacgttacgttcgtacgttagttcgttattccgtttcccttacccgtacgtccggttacgttcgggaccggtaacgggtaacgtaagggtacgtaggaacttacccgtaaatcggtcgtacggccacgtaccctattccg

SEQ ID NO: 4875 - DNA, 580 bp, Homo sapiens
  misc_feature: GYAE6OF01ERLL5.2.78.H01.1.454.CMB.1.raw
  modified_base (568)..(568): a, c, t, g, unknown or other
  misc_feature (568)..(568): n is a, c, g, or t
tcagacgctcgacacacgaccggtgctcgatttagtgtgagtagtttgggtttgggggcaggagtcagacccagtcaggacacagcatggacatgagggtcccgctcagctcctggggctcctgctgctctggttcccaggttccagatgcgacatccagctgacccagtctccttcttcgtgtctgcgtctgtgagagacagtacttactatcacttggtcgggcgagtcaggattattacgacctaacttagcctggtatcagcagaacgccgtgggcgacgacccctaaactcctgatctatggtgcatacaagtctagacgtaaaggtcgggtacccagtcgtagttcgaggagcgtaggtggatcgtagggacagtacttcactctacacatcagtcgactcgcgacgtctagaacgtacttcgtacgtactaactttacgtattacgtactagttagttcgttacgttactttcccgttcccggtacgtaccgttacggtttcggaccgaaggggtacctaagggtaggatacgtaaaccgaaaggacgttcggacggtacncgtaccactacg

SEQ ID NO: 4876 - DNA, 657 bp, Homo sapiens
  misc_feature: GYAE6OF01BZ721.2.78.H01.1.454.CMB.1.raw
tcagacgctcgacacacgaccggtgctcgatttagtgtgagtagtttgggtttgggggcaggagtcagacccagtcaggacacagcatggacatgaggtccccgctcagctcctggggctcctgctgctctggttcccaggttccagatgcgacatccagctgacccagtctccttcttcgtgtctgcgtctgtgagagacagtacttactatctacgttgtccgggcgtagtcgaggtattagttaacgtaaccaacttagccgtggtatcagacaggaacgccgtgggcgaacgtacccctaaactccgtgactcgtagtggtcgactatacaagtcgtacgaacgtaaacgggtcgggtacccagtacggtacggttcgaaggtacgcgtaaggtcggtacgtcggtacgggaactaacgtacgtttacgacttaccgtacctaccgtactcggaacgtcccgcgtcgaccacgtccgtaagaacgttactcgtagtacccttaacgttacgttaactcgttacgtagtcgtttactcgttacctttccgttccgacttaccggttcgttagggacccggaagggtaaccgaagggtaccgaagtaccgtaacgtaaacggtcgttaggtcgtacgtaacgccgtacgttacgg

SEQ ID NO: 4877 - DNA, 600 bp, Homo sapiens
  misc_feature: GYAE6OF01COM3G.2.78.H01.1.454.CMB.1.raw
  modified_base (587)..(587): a, c, t, g, unknown or other
  misc_feature (587)..(587): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatctacttgtcgggcagtcaggatattagtaccaattagcctaggtatcagcaagaagccgtgggcgacgcccctaaactcctgatctagtggtgcatcaagtctagacaaggtcgggtccagtcgaggttcaggaggcaggtggactcgtagggactagtactttcactctcaacctatccgacggcggtcctgaccacggtccctaggaaacgtctttcgtacgtaccttaaactttaccttatttcgtacctaaggttacgtttcctagttaccttttcccgttccccggcgttaccgttacgggtttcgggaccggtaacggggaaccgtaagggtagaacgtacgtaacgaaaccgtacgtggtacgacncgtacaccgtacg

SEQ ID NO: 4878 - DNA, 566 bp, Homo sapiens
  misc_feature: GYAE6OF01C987Y.2.78.H01.1.454.CMB.1.raw
  modified_base (184)..(184): a, c, t, g, unknown or other
  misc_feature (184)..(184): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgngtctgcgtctgtgagagacagtacttactatctacttggtcgggcgagtcaggatattagtaccaattagcctggtatcagcaagaagccgtgggcacgccccctaaactcctgatctagtggtgcatcaagtctagactaaaggtcgggtcccagtcgaggttacagaggctagtggatcgtgggacagtatttcactcctacaccatccgagccggtctgacagcctagaagtattagcgtactaacttactagttagactagtagtttctcgtactttccgttcccgtacgtccttacggtttcggacccggacggggaaccgtaaggggtacaaggtataaccgaaacggtaacgtcggtagacttacgctacctacg

SEQ ID NO: 4879 - DNA, 913 bp, Homo sapiens
  misc_feature: GYAE6OF01D0XKO.2.78.H01.1.454.CMB.1.raw
  modified_base (106)..(106): a, c, t, g, unknown or other
  misc_feature (106)..(106): n is a, c, g, or t
tcagacgctcgacacacgaccggtgctcgatttagtgtgagtagtttgggtttgggggcaggagtcagacccagtcaggacacagcatggacatggagggtccccnctcagctcctggggctcctgctgctctggttcccaggttccagatgcgacatccagctgacccagtcctcctttctttcgtgtctgcgtctgtgagacgacagtacttactatctacgttggtcgggcgagtcaaggtatacttagaccaagttagcctaggtatcagacgagaacgccgtagggccgaaccgtacccccttaaactccgtagacttccgtaagtggtcgactagttctaaacgttcgtacggaacgtaaaacgggttcggggtacccctaaggttacggtaacggggtttaaccgaaggggtaacgggtacggtaaggttagggtaacttacggggtacggggtaaccgtaaggtttaacttttacccgaacctttccgttaacccaaccgtaacgttaccccggaacgggtccccggggttacccttacgggaacccgttaaccgggtcccgttaaggggtaactttaacccgttttccgttaacggttaacccctttaaaaccgtttttaacgttaacttttcgggttaaccgttaaggtttaacgttttacccggttaggttttaacccctttttcccccgggtttaccccgggtaccggttaccgggttttaacccgggggttttaccgggtaaccccggggtaaacgggggttaaacccggggttaaaacggggttaaccggtaaacggttaaacccgtaaaacccggtaaaaacccgggtttaacccgggtttcggggttaaacggaccccgttttacccgggaaaccccgtttaaccccgttaaccggg

SEQ ID NO: 4880 - DNA, 678 bp, Homo sapiens
  misc_feature: GYAE6OF01EQYJG.2.78.H01.1.454.CMB.1.raw
  modified_base (422)..(422): a, c, t, g, unknown or other
  misc_feature (422)..(422): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
tcagacgctcgacacacgaccggtgctcgatttagtgtgagtagtttgggtttgggggcaggagtcagacccagtcaggacacagcatggacatggacgggtccccgctcagctccgtggggctcctgctgctctggttcccaggttccagatgcgacactccagctacgacccagttccttccttctttcgtgtctgcgtctgtgagagacagtacttaactatctacgttggtcggacgagtcgagtattagttaacgtacctaacttgacctggtatcagacgagacgccgtagggaccgacgacccctaacgtcctagtacttacgtagtcggtacgacctatacgtaagttcgacgtaacggtaaacgggtccgggtaccctaggtacggtacggttacgagacggataggtacggntacggagactagttcttacactcctacacctanagacngtacgtacacgtacctaagtagtaatttacgtttacaaccttaattaactacgtagtaaccaagttacgtacttaccggtacccgtaccgtacgggtaaccgtaccggaaaccggtaacggtaaccgtaaagggtaaagtaaccgtaacgtaaaccggagtttccgggacgttaccaacggtaacccttaaccgtgtttccccgttatcccgttaccg

SEQ ID NO: 4881 - DNA, 828 bp, Homo sapiens
  misc_feature: GYAE6OF01AKHIH.2.78.H01.1.454.CMB.1.raw
  modified_base (121)..(121): a, c, t, g, unknown or other
  misc_feature (121)..(121): n is a, c, g, or t
  modified_base (183)..(183): a, c, t, g, unknown or other
  misc_feature (183)..(183): n is a, c, g, or t
  modified_base (667)..(667): a, c, t, g, unknown or other
  misc_feature (667)..(667): n is a, c, g, or t
tcagacgctcgacacacgaccggtgctcgatttagtgtgagtagtttgggtttggggcgaggagtcagacccagtcaggacacagcatggacatgaggtcccgctcagctcctgggctccngctgctctggttcccaggttccagatgcgacatccagctcgacccagtcctccttcttcgtntctgctctgagacagacagtcttaatctctacgttggcgggactagtccgtagtatttacgttacgaacctacttacgtccgttaggtacttcgaacgtacgtaacggtaacgtacccggttaggaccggtaaccgtaacccccgttaaacccgtacccgttaacggttacttaccggttaaacggttacgggtccgtaacgtaccgttaaccgtaaaccgttccgttaacgtaacccggttaaacggggttcccggggtaaccccttaaccgggtttaccgggtaaaccggtttaccgaaacgggtaacgggtaccggtacgggtttaacgggtaaccgttacgggttaacggggtaaacctaacggttaactttacgtacccgttaccgtacctaaccgtacgtccgtacggacccggttccgtagaccgaacgtaccgtagtactttacgcctacgtaacctaactttacgtagttccgtntaaccggttataccgttgtttaccttcccgtttaccgggacctacgttacggttccggtaaccggtaccgggttaaaccgttaacggtacgttaaaggtacccttaaaccggtaaacttacccgggttgacccgttaacgtcggaaaacccgttcgtaccg

SEQ ID NO: 4882 - DNA, 725 bp, Homo sapiens
  misc_feature: GYAE6OF01BVDS2.2.78.H01.1.454.CMB.1.raw
  modified_base (535)..(535): a, c, t, g, unknown or other
  misc_feature (535)..(535): n is a, c, g, or t
tcagacgctcgacacacgaccggtgctcgatttagtgtgagtagtttgggtttgggggcaggagtcagacccagtcaggacacagcatggacatgacggtccccgctcagctcctgggctcctgctgctctggttcccaggttccagatgcgacatccagcctcgaccctagttccttcctttctttcgtgtcctgcgttctggtgaagagactagtacttaactactcctacgttggtcgggacagtcgaaggtacttaacgttaacgtaacctaaacgttacgtaccgttaggtactaccgaagacgtaagaacggccggtacgggaccgaaccgtaccccctaaacgtccgtagtacttcgtagtcggtacgtactaactacgtaacgtctaaggtaaccggtaaacgggttccgggtaacctacgttacggtaacggttacgaacgggtaggacgtaggtacggtagtcggtagggtaacttagtactttaccgtaccttctaactacctacgtaccgacggtccggtacncgtactacgtacgtagtaacgttctcgtacgtaacttaactttacttagttcgtacgtacgttacgttcgttacgttacccgtttccgtcccgtacgtcccggttacggttacgggacccggtaacgggtaacgtaacgggtacgtaacgtacgtaacgtaaacgtacgtcggtacgctacacgtctacg

SEQ ID NO: 4883 - DNA, 655 bp, Homo sapiens
  misc_feature: GYAE6OF01CWR9S.2.78.H01.1.454.CMB.1.raw
  modified_base (535)..(535): a, c, t, g, unknown or other
  misc_feature (535)..(535): n is a, c, g, or t
  modified_base (644)..(644): a, c, t, g, unknown or other
  misc_feature (644)..(644): n is a, c, g, or t
tcagacgctcgacacacgaccggtgctcgatttagtgtgagtagtttgggttgggggcaggagtcagacccagtcaggacacagcatggacatgaggtccccgctcagctcctggggcctcctgctgctctggttcccaggttccagatgcgacatccagctgacccagtccttccttcttcgtgtctgtcgtctggtgagagacagtacttactatcacgttggcgggcgagtcaggtataagtacgtaacctagtagtcctaggtactcgaagacgaagacggccgtagggaccgaccgtaccccttaacgtcctagtactacgtagtcggtacacgtactacgtaagttctaggaacgtaacgggtccgggtacctagtacggtacgttcgaagggcgagtaggtcgagtacggtaggactagttactttacaccgtacctaccgaacctagtaccgtaccggtaccggtaccgtacgtaccgacgtaccgtacgtaacggtcttacgtaacgttactaaacctttacgttnttacgtactagttcgttacttcgttacctttctacccgtgttaccgtacggttccggacggtagggtaacgaggtacgacgtaacgacgtaaccgtgtcgtacagtacnccctaagtccg

SEQ ID NO: 4884 - DNA, 697 bp, Homo sapiens
  misc_feature: GYAE6OF01APBSR.2.78.H01.1.454.CMB.1.raw
  modified_base (317)..(317): a, c, t, g, unknown or other
  misc_feature (317)..(317): n is a, c, g, or t
tcagacgctcgacacacgaccggtgctcgatttagtgtgagtagtttgggtttgggggcaggagtcagacccagtcaggacacagcatggacatgagggtccccgctcagctcctgggctcctgctgctctggttcccaggttccagatgcgacatccagctgacccagtcctccttctttcgtgtctgcgtctgtgagagacagtacttactatcacttggcgggcgagtcaggtatagttacgtacctaacttagcctaggtatcagctaaggaagcctgggcgacgacccctaaactccgtagactctatggtncgatcgtaagtctgacgtaaaggtcgggtaccctagtcggtagtcgacggacggtcgtaggtggtacgtcggtagggaacgtacgttacgtttaccaccttacgtacccgaaccgtactccgtaacggccggtcctacggactacgtccgtaaggtaacgttacttccgtacggtaaccttaaaccgtttacttaacgtttacgttacgtaacggtttcgtttacgttaccgtttaccgttttcccgtttacccccgggacgttaccggttaccgggtttacgggacccgggtaacggggtaaacccggtaagggtacgtaacgtaaccgttaaccgtaaaacggtaacgtcggtacgtaccgcgtaccgtaccgttacg

SEQ ID NO: 4885 - DNA, 753 bp, Homo sapiens
  misc_feature: GYAE6OF01AS7B0.2.78.H01.1.454.CMB.1.raw
  modified_base (184)..(184): a, c, t, g, unknown or other
  misc_feature (184)..(184): n is a, c, g, or t
  modified_base (324)..(324): a, c, t, g, unknown or other
  misc_feature (324)..(324): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgngtctgcgtctgtgagagacagaccttactatctacgttggtccgggcgtagtcgaggtatattaacgtacctaacttacgcctggtactcgagacagacgcctgggaccgacgacccctaactcctagactctagtggtnactactacgtaacgtctagtaccggtaaaggtcgggtaccctaggtacggtagggttaccagggacggtacgtaggtgggtattccggtaggggaactaggttacttaccgtactcctacaaccctacgtaccgacgggtacccgccgttacgaccgtacgggtaccctaagggtaacgttacgtttaccgtacggtaacctttaaccgtttaacttacgtttcggttacctaaggttaacgttttccttacggtttaccctttaccccggttttccccggacgggttacccgttacggggtttacccggaaccgggttaacgggggtaaaacccgtaggggttaaacggtaccgttaaacggtaacccggtaaaaggttacccggttacgggtaccggtaccggtaccgtaaccgtaaccggttaccg

SEQ ID NO: 4886 - DNA, 723 bp, Homo sapiens
  misc_feature: GYAE6OF01CJGDV.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttggtcgggcgagtcaggtattaattacgtaaccaacttagccttggtatcagcaagaagcctagggcacgaccccgtaaactccagatctagtggtacgactaatcaaagttcgtacgacgtaaaagggtcgggtaccctaaggttcgtaaggttacgaagggacggacgtaaggttaggaacttcgggtagggaacctaaggttactttccgactttccgaccaaccttacgctacggacccgggtccctaggaccgtaaccgtacccggttaagaaacggtttactttaccgtacggaaaccctttaaaacccttttaagtaaccgttttaacggtaacccgtaaaggttaccggttttactacggtttaaccgttttccccttaaccccggggcttaaccggttacgggtttacggacccgggtaaacggggtaaccgaaggttacgaagttaacgtaaaacgaaccggtactcgggttaacgaccctgaccgtaacgtacg

SEQ ID NO: 4887 - DNA, 790 bp, Homo sapiens
  misc_feature: GYAE6OF01CRU9U.2.78.H01.1.454.CMB.1.raw
  modified_base (182)..(182): a, c, t, g, unknown or other
  misc_feature (182)..(182): n is a, c, g, or t
tcagacgctcgacacacgaccggtgctcgatttagtgtgagtagtttgggtttgggggcaggagtcagacccagtcaggacacagcatggacatgacgggtccccgctcagctcctggggctcctgctgctctggttcccaggttccagatgcgacatccagctcgacccagtccttccttntttcgtgtctcgcgtctgtgagagacagtacttactactctacgttggtcgggcgtagtcgaaggtattaacgttaacgtaaccctaacgttacgtccgttagggtaactcgaacgacgaacggtaacgtccggtacggggccgaacccgtaccccgtaaactccgtacgtactcgttaagtcggtacgtactacgtacgtaagtcgtacggaacggtaaacgggtccgggtacctaggttacggtacggttacgaagggtacggtactaagggttacggacgttcggtacgggaacttagttactttaccgacttccctaccgtacctacgtaccggacggtccgtcctacggacgtacgtaccgtaggtaactacgttccgtacgtaaccttaacgtttacttacgttacggtacttaacggttacgttaccgttacggttacccttttcccggttacccggtaccggttccgggttaacccggttttcggggaaaccccgggtacgggggttaaacccgtaaagggttaaccggtaaacggttaacgtaaaccggtaaacggttaccggttacggtacggtacgtaccgtaccgtaccgttaccg

SEQ ID NO: 4888 - DNA, 652 bp, Homo sapiens
  misc_feature: GYAE6OF01CYA5C.2.78.H01.1.454.CMB.1.raw
  modified_base (183)..(183): a, c, t, g, unknown or other
  misc_feature (183)..(183): n is a, c, g, or t
  modified_base (328)..(328): a, c, t, g, unknown or other
  misc_feature (328)..(328): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttcttcgngtctgcgtctagtgagagacagtacttacatctaacgttggtcgggcagtcaggtatattacgtaaccaacttagcctaggtactcgagacaagaagccgtcgggacgacgacccccttaaactcctagtacttcgtagtgggtnacctaatacgtaacgtcgtagacgtaaacggtcgggtacccagtcggtaggtcaggagtcgaggtggtactacggtagggtaactaagtactttccgaacttcctacgacctagtccgagtcccgcgtacgccacgaccgtaggaagtcttacgtacgtaccttaaacttacttacttggtaacgtaacgttaggtttccgttagttcctttccccgtttacccgcgttaccgtaccgggttcggaacccgggtagggaacccgtaaggtacgaaggtaacaccgtaaaacgtacgtcggacgtactacggacctaccgttacg

SEQ ID NO: 4889 - DNA, 643 bp, Homo sapiens
  misc_feature: GYAE6OF01BYP5U.2.78.H01.1.454.CMB.1.raw
  modified_base (214)..(214): a, c, t, g, unknown or other
  misc_feature (214)..(214): n is a, c, g, or t
  modified_base (309)..(309): a, c, t, g, unknown or other
  misc_feature (309)..(309): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactanctacgttgtcgggcagtcaggatatacgtaccaacttagcctggtatcagcagaagccgtgggcgacgcccctaaactcctagatctagtggtcncatacaagtcgtgacgaaagtcggggtaccagtcgtaggtcgaggtaggacaggtggtatcgtagggaactagtactttcactctaccactactcgacgcggtaccctgcacggtcctaggtaactacgttcgtacgtaccttaactttactaacgtttcgtacgtaagttacgtttcgttagttaccgttttcccgtttcccggaccgttccggttacggtttccgggacccggtaacgggggtaaccgtaaacggggttagaaccggtaacgtaaacccgtaaaacggtaaccgttgggttacggacccggttacgaccccgtacgttaacg

SEQ ID NO: 4890 - DNA, 771 bp, Homo sapiens
  misc_feature: GYAE6OF01DS6QU.2.78.H01.1.454.CMB.1.raw
  modified_base (156)..(156): a, c, t, g, unknown or other
  misc_feature (156)..(156): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgccganatccagctgacccagtctcctttctttcgtgtctgcgtctgtgagagacagtacttaactactcgtacgttggtccgggacgtagtcgaaggtattaacgttaacgtaacctaaagtttacgccttaggtactcgaagtcaagaacggtccgtgggaccgacgtaccccctaaactcctagtactcgtagtggtcacagttacgaagtctaggaacgtaagggtcgggtacctagttcggtaggttacgaaggtacggtacgtaagggttaggtacttacggtagggtaacctaaggtacttttaccgacgttacctacgtaacccaagttcccggacggtcccgggtacctaccggacgacgtacccggttagaacggttaccgttaccgtacgtaccttaaaccgtttaactactttaggaaccgtacgtttagttaccgtttacggttaccttttcccggttaccccggacgttaccggtttaccgggttaccggggaaaccggtaacgggggtaaacccgtaaacggggaacgttaaacgttaacccggtaaaaccgtaaaacccgggttagtacggtaccgggtaccttaacccggacgtccgtttaacg

SEQ ID NO: 4891 - DNA, 786 bp, Homo sapiens
  misc_feature: GYAE6OF01B5NC8.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttccccaggttccagatgcgacatccagctcgacccagtctccttctttcgtgtctgcgtctgtgagagacagtacttactactcacgtttggcgggacgtagtacgaaggtattaacttacgtaacctaaacgttacgaccgttaggtaactacgaacgtacgaacggtaacggtccgtaggggaccgaaccgtaaccccccttaaaacgtcccgtagacttactagtggtacactaagtactaaagtcgtacgaacgtaaaacgggttcgggaccctaagtcggtaaggttacgaaggtaggactaagggtacgtacgtcggtacgggaaccttaagtaacttttaccgaacttaccgttaaccgaaccctaagtaccgaacggtcccggtacccgtacgtacccgtaacggttacccgtaaggtaaacgttacttaccgtacgtaaccttaaactttacgttaagtttcgtaacgttagtaaccgtttacgtacgttaaccttttcccggttacccgaccggttaccgttacgggtttaccggaaccgggtaaacgggttaaccgtaaaagggttaacgaacgtaacgtaaacccgtaaaacggtaacgttcgggtaacgtacttaccggtaaaccgtaccgttaacgg

SEQ ID NO: 4892 - DNA, 724 bp, Homo sapiens
  misc_feature: GYAE6OF01CFPBG.2.78.H01.1.454.CMB.1.raw
tcagacgctcgacacacgaccggtgctcgatttagtgtgagtagtttgggttgggggcaggagtcacgacccagtcaggacacagcatggacatcggagggtccccgctcagcctcctggggctcctgctgctctggttcccctaggttccaggatgcgacactccaggctcgaccctagttcctcctttctttcgtgttctggtccgtcgtgtggaggacgactaagtactttaacactccgtcggttggtcggggcgtaggtcgaaggtacttaacgttacgtaaacctaacgtttacgccgttaggtactacgacgacaaggaacgtcgtacggaccgaccgtaacccctaaacctccgtaacgtctaccgttagtggtacaccgtatacgaacggttcgacggacgtaacgggtccggtacctaggtacgtagggttaccaaggtcggtactagggtacgtacgtacggtacgggaacttacggttactttaccacgttcctaacgaacctacgtccgacggtccgacctgacacgtcgtaagacgttactacgacgtaacttactttagtaacgtcgacgtaacggttccttacgtacgttacccttcccggttccggaacgttccgttaccgggtcggaccggtaagggtaaccgtaggaacgtaactaacgttaaaccgtaacgggttcgtagggtctaacggtcctactcggtacg

SEQ ID NO: 4893 - DNA, 122 bp, Homo sapiens
  misc_feature: GYAE6OF01EO0V6.2.78.H01.1.454.CMB.1.raw
  modified_base (111)..(122): a, c, t, g, unknown or other
  misc_feature (111)..(122): n is a, c, g, or t
tcagacgctcgacacacgaccggtgctcgatttagtgtgagtagtttgggttgggggcaggagtcagacccagtcaggacacagcatggacatggacggtccccgctcagnnnnnnnnnnnn

SEQ ID NO: 4894 - DNA, 825 bp, Homo sapiens
  misc_feature: GYAE6OF01BYO37.2.78.H01.1.454.CMB.1.raw
tcagacgctcgacacacgaccggtgctcgatttagtgtgagtagtttgggttgggggcaggagtcagacccagtcaggacacagcatggacatggacgggtccccgctcagctccgtggggctcctgctgctctggttcccaggttccagatgcgacactccagctacgacccctagttccttccttcgtttcgtgtctgcgttctgtgagagaccagtacttactactctacgttcggtcgggacagtacgaggtattaacgttacgtaacctaacgtttacgaccgttaggtaacgtccaaggaccgtaaacggaacggtcccggtacggggacccgtaaaccccgtaccccccgttaaaaccgtcccgttaggtaacccgtttagtaacgggttcggtaccgtacctaaacgttaccgtaaacggttccgtaacggtaacggtaaacgggggttcccgggtaaccctaaggttaccggtaagggttaccgaagggtacgggtactacgggtacggtacgttacgggtaagggtaacctaaggtttaccttacccgtacctaccttacaaccgtacgtccgaacggtcccgtaccgtacggaacctacggtacgtaagttaacgtactttaccgtacgtaaccttaacgtttacgttactttcggtaacgttaggttacgttacgttaccgttaccgtttcccggttcccgtacgtcccggttacggttccgggaacccggtaacggggtaaacgtaggtaacggaacgtaaacgttaaccgtaaaccggttacgtcggtaacgcgtaacgccgtacgttacc

SEQ ID NO: 4895 - DNA, 653 bp, Homo sapiens
  misc_feature: GYAE6OF01AXFUU.2.78.H01.1.454.CMB.1.raw
  modified_base (184)..(184): a, c, t, g, unknown or other
  misc_feature (184)..(184): n is a, c, g, or t
  modified_base (642)..(642): a, c, t, g, unknown or other
  misc_feature (642)..(642): n is a, c, g, or t
tcagacgctcgacacacgaccggtgctcgatttagtgtgagtagtttgggtttgggggcaggagtcagacccagtcaggacacagcatggacatgaggtccccgctcagctcctggggctcctgctgctctggttcccaggttccagatgcgacatccagctgacccagtcctccttctttcgngtctgcgtctgtgagagacagtacttactatcacgttgcgggcgagtcaggattatagtaccaattagcctggtatcagcagaagcctgggcgacgcccctaaactcctgattctagtggtgcatactaagtctagaacgaaaggttcgggaccctagtcggtagttacgaggaggcgagtggatcggtaggaactagtatttcgaccttactaccaccgtatcgaacggtcggtacctcgggctacggtacccgttagaaacgttcgttaaccgtcgtaaccctaaacttttaacctagtttacgtacgtaagttcgtttacgttagttaaccttttcccgttccccggacgtaccgttaacgggttttccggaccgggtaaccggggtaacgtaacggggttaagaacggtaaaccgttacgaaaacggtaccgttgggtacgtcctacggtaccnccgttaaaccg

SEQ ID NO: 4896 - DNA, 540 bp, Homo sapiens
  misc_feature: GYAE6OF01EBDGN.2.78.H01.1.454.CMB.1.raw
  modified_base (397)..(397): a, c, t, g, unknown or other
  misc_feature (397)..(397): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcagtcaggatattagtaccaacttagcctggtatcagcagaagcctgggcgagcccctaaactcctgatctatggtgcatcaagtctgcaaaggtgggtcccatcgaggttcagaggcagtggatcgtgggacagatttcactctcaccatcagcggctgcagcctagaatnttctgcctaactttactattcgtcagtagttctgtactttccgtttcccgcgtaccgtacggtttcggcccgaagggggtacccgaagggttagaacggtactaccgaaaacgtaccgtggtacggactcggcctaccgtacg

SEQ ID NO: 4897 - DNA, 619 bp, Homo sapiens
  misc_feature: GYAE6OF01B7KP8.2.78.H01.1.454.CMB.1.raw
  modified_base (105)..(105): a, c, t, g, unknown or other
  misc_feature (105)..(105): n is a, c, g, or t
  modified_base (176)..(176): a, c, t, g, unknown or other
  misc_feature (176)..(176): n is a, c, g, or t
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
  modified_base (542)..(542): a, c, t, g, unknown or other
  misc_feature (542)..(542): n is a, c, g, or t
  modified_base (611)..(611): a, c, t, g, unknown or other
  misc_feature (611)..(611): n is a, c, g, or t
tcagacgctcgacacacgaccggtgctcgatttagtgtgagtagtttgggtttggggcaggagtcagacccagtcaggacacagcatggacatgacggtccccgntcagctccgtgggctcctgctgctctggttccccaggttccagactgccgtaacactccgagcctgacccngttcctccttagttcgntctgctctagngacagacagtacttanactcagttggcggnacgtgagtanattacgacatacgctaggtacncatacgagacgtccgngggaccaccgtacccctaactctagtntacgtagttcggacgtaccanacgttaaacgtccgtaagacgtaagggtccgggtaccaggtcggttaagtcgagaaggtcgtaggtcgaagtcggtaggacgtagttacttcacttacccacacgtacacggacgtccgctagaccgtacgtagtacgaagttcttacgactaacgttacttagtttaccgtgttaaccgagttgtttccctagtttacccgttctccggtntaccggtttaggtccgacggtaaacgggtactagggtaacacggtaacgtacaacgtacgtgctacgtncgtactcg

SEQ ID NO: 4898 - DNA, 703 bp, Homo sapiens
  misc_feature: GYAE6OF01B0AEE.2.78.H01.1.454.CMB.1.raw
  modified_base (289)..(289): a, c, t, g, unknown or other
  misc_feature (289)..(289): n is a, c, g, or t
  modified_base (435)..(435): a, c, t, g, unknown or other
  misc_feature (435)..(435): n is a, c, g, or t
tcagacgctcgacacacgaccggtgctcgatttagtgtgagtagtttgggtttgggggcaggagtcagacccagtcaggacacagcatggacatgacgggtccccgctcagctccgtggggctcctgctgctctggttcccaggttccagatgcgacactccagctcgaccagtctcctttctttcgtgtctgcgtcgtgtgagagactagacttactactcgtacgttcggtcgggacgagtcgaaggtattaacgttacgtaacctaacgtttcggccttaggttancgagacgtaaggaccgtcggtacgggaccacccggtaccccttaagtcctgtacttcgtagtggcactgtactacggtcaggaacgtaacgggtcggacctagtacggtacggtacgacggtaggacgtaggtcggtacgttcggnggtaaccgatttacgttcctacgtaccgttaccaaccgtacgacggtccgcgggtaccctagccacgttacggaagggaccttttacgagttacctactttaaccgttagttcgtacggtaagtactttcggttaccttgggtttaaccctttccgtccggtcgttaaaccgtcgggtaccgggtaccggtaacggaacgtaaagggtaccgaacttacgggaaacgttaaccgtcgggttcgaccgtattacggaccgtaatttcgg

SEQ ID NO: 4899 - DNA, 617 bp, Homo sapiens
  misc_feature: GYAE6OF01BMSA6.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctcgacccagtcctccttctttcgtgtctgcgtctgtgagagacagtacttactatcagttggcggcgagtcaggtattagttacgtaacctaacttagcctaggtatacgagacgaagaacgtccgtagggcgaacgaccccctaaactcctagaacttcgtaagtggtcgactattaccaaagtcgtagaacgtaaaggtcgggtcccaagtcggtaggttacaaggacggtcaggtgatcgaggacagtacttcactctacacatcgagcgctagcacgtcctagaatcttcgactaccttaacttacgtattcgtactaagtagttaccgtagttctttaccgttccgacgtacgttacggtttacggaccgtaagggaaccgtaaagggtagaacgtaacgtaaccgtaaaacggtaacttcgggtacgacgtacgtaccgaccgttaacg

SEQ ID NO: 4900 - DNA, 706 bp, Homo sapiens
  misc_feature: GYAE6OF01ADB3K.2.78.H01.1.454.CMB.1.raw
  modified_base (572)..(572): a, c, t, g, unknown or other
  misc_feature (572)..(572): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagttcctccttctttcgtgtctgccgttctgtgagagacagtacttactatccacgttggtcgggcgtagtcgaggtattagttacgtaacctaacttacgcctaggtatcagtacaggaacgccgtgggaccgaccgtaccccctaaactccgtagactcgttagtggtgctactaccgtaagttccgtaggaaccgtaaaggggtccggggttaccccaggttaccggtaaggtttaccgaagggacggacgtaaggtggtaacgttcggtacgggaactaacggttactttccaccgttacctacccaacctactccggaacggtcccggtacctcgaaccgtaggtaccctaagacgtacttccgacgtaccttaacttactagttcgtaactacggttnttacgttcgttactttccccgttaccgccgtacggttaccggttccggacccggtaagggtaacgtaacgggtacgtaaacgtaccgtaaacggtaaaccgtacggtcggtacgacgtccgaccgtacgttacg

SEQ ID NO: 4901 - DNA, 618 bp, Homo sapiens
  misc_feature: GYAE6OF01C5DYF.2.78.H01.1.454.CMB.1.raw
  modified_base (270)..(270): a, c, t, g, unknown or other
  misc_feature (270)..(270): n is a, c, g, or t
  modified_base (323)..(323): a, c, t, g, unknown or other
  misc_feature (323)..(323): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
tcagacgctcgacacacgaccggtgctcgatttagtgtgagtagtttgggtttgggggcaggagtcagacccagtcaggacacagcatggacatgagggtcccgctcagctcctggggctcctgctgctctggttcccaggttccagatgcgacatccagctgaccagtctcttctttcgtgtctgtcgtcgttgcgagagacagacttacgtatctacgttggtcggacgtatacaggatagttagtaaccaaattacgcctaggttanacgagacaagacgccgtggacaagcccctaaaactcctagactctagtggtancagtcaaagctagacgtaaaggtcggtaccatcggagtacgagnggactagngactcggngactagtattcacgttacacactanacgagtccgngtactacgacgtaanagtacttcgacgtacttaactttataggttactacaacggtagtttcttacgttacgttccctttacgtccgtaccggttaacggtttggaacccggtaaagggggtaccctaaagggaacgtaaggtaacgtaaaccgaaaacgtacgttaggtacggtaactcggaaaccctccgtgttaccg

SEQ ID NO: 4902 - DNA, 600 bp, Homo sapiens
  misc_feature: GYAE6OF01AHEMM.2.78.H01.1.454.CMB.1.raw
  modified_base (180)..(180): a, c, t, g, unknown or other
  misc_feature (180)..(180): n is a, c, g, or t
  modified_base (197)..(197): a, c, t, g, unknown or other
  misc_feature (197)..(197): n is a, c, g, or t
  modified_base (431)..(431): a, c, t, g, unknown or other
  misc_feature (431)..(431): n is a, c, g, or t
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
  modified_base (494)..(494): a, c, t, g, unknown or other
  misc_feature (494)..(494): n is a, c, g, or t
  modified_base (501)..(501): a, c, t, g, unknown or other
  misc_feature (501)..(501): n is a, c, g, or t
tcagacgctcgacacacgaccggtgctcgatttagtgtgagtagtttgggtttgggggcgagggagtcagacccagtttcaggacacagcatggacatggacggtcccgctcagctccgtgggctcctgctgctcttcggttcccaggttccagatcgacgacactccagctacgacccngtcctccttctttcgtntctgcttctgtcgagagacctagtaccttaactacgttctacgttggtcgggaccgtagtccgaggtaacttgttaacgtacctaacttacgtacccgttggtactcagtcgaagacgtccgtgggccgaacgtacccccgttaaactccgtcgactcgttagtcggtacgtcacttacgagttcagaccgtaagggtccggtaccagtcgtaagtccagacggctaggtacgnttacggaggtacagttcttcgactctacnctactgacgccgtcngccngctagactattcgancctaatnttagtactgtatcgtatcgtaccttcttcgactctggtcgacgaaccgggtgaagtcgaataccacggtaacagttcggtaaccggtactctcgtaacg

SEQ ID NO: 4903 - DNA, 754 bp, Homo sapiens
  misc_feature: GYAE6OF01EBPZQ.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtcctcctttctttcgtgtctgcgtctgtgagagacagtacttactatcctacgtttcggtcgggccgtagtcgaaggtattaattaacgtaaccctaacgtttagccgttaggttactcagaccaagaacgcccggtagggaccgaccgtaacccccttaaacctcctagtacttcgttagttcggtcgactacgtacgtaacgtctacggtaaccgtaaagggttccggggtaccctagttaccggtaacggttaccgagggacggacgtaggtacggtacgttacgggtagggaacctaaggttaactttcccgtaaccgttccctaaccgtaccctaagtccgacggtcccggtccgtacgaccgtacgtacccgtaagtaacgttaccttcgtacgtaaacccttaacgtttaacttacgtacgtactaacggttacgtttcgtacgtttacctttcccgttacccgcggttaccgttacggttccgggaaccggaaccggggtaacgtaagggtacgaaagtaaccgtaaacgtaaacggttacggttacggacggtacctacgtacccgaacgttacg

SEQ ID NO: 4904 - DNA, 771 bp, Homo sapiens
  misc_feature: GYAE6OF01ANF0O.2.78.H01.1.454.CMB.1.raw
tcagacgctcgacacacgaccggtgctcgatttagtgtgagtagtttgggtttgggggcaggagtcagacccagtcaggacacagcatggacatgacgggtccccgctcagctccgtggggctcctgctgctctggttcccaggttccagatgcgacatccagctcgacccagttccttccttctttcgtgtctgcgtctgtgagagacacgtacttactatctacgttggtcgggcgacgtacgaggtaattacgtttaacgtaaccctaaccgttacgtaccgttaggttaacgtcgtaaaaaaaacgtcgaaggaacggtcccggtagggaccgtaaccgtaaccccccttaaacctacccgtacgtacttacgttagtacggtcgacgtactaccgtacgtactacgacgtaacgggtacgggtacccgtacgtacggtacggttacgaaggcggtacgtaggtacggtacgttcggtagggactagtacttctaccttacctaccaccgtactccgacgtccggtaccgtcgacgtaccggtaccgtacgtaacgttacgttaccgtacgtaaccttaaccttacttacgttacgttacgttaacgttacgttacgtttacttaccgtttcccgttacccggtaccggtaccggtttaccggtcgggtacccggtaaccggggtaaccgtaacgggtaacgtaacggtaaccttaacccggtaaacggttacgtacgggtacgtacctaccggtcctaacgtaccg

SEQ ID NO: 4905 - DNA, 785 bp, Homo sapiens
  misc_feature: GYAE6OF01CDTN6.2.78.H01.1.454.CMB.1.raw
  modified_base (612)..(612): a, c, t, g, unknown or other
  misc_feature (612)..(612): n is a, c, g, or t
tcagacgctcgacacacgaccggtgctcgatttagtgtgagtagtttgggtttgggggcaggagtcagacccagtcaggacacagcatggacatgacgggtccccgctcagctcctggggctcctgctgctctggttcccaggttccagatgcgacatccagctcgaccctagtcctccttctttcgtgtctgtctctgcgagagactagtaactttactatacgtaccgtttcgggcgggcgtaagtcgaaggtatttaaagttacgtaaccctaacgtttaacgtcccgttaggttaactcgaagacgtaaacggaacggccggttacggggaccgaaccgtaccccctaaaacgttccctaaggtacttcgttaggtggtacgtactactacgtaacgtctacggaacgtaaagggtccggtaccgtaacgtcggtaaggttacgaaggacggtaggtacgtacggtacgttagggtaccgggtacgtacgttacgtttaccctcgttaccttacccgaccgtacttccgaaccggtcggacccgttacgacccgtaacgccttagggaaactttcgttaccgtacggtaaccttaacgtttaacgttntaccgtagttaactacggttcctttacgccggttttacccttccggtacgttaccgggtttaccggtacgggtaacccgggtaacgggtaacgggtaaccggttaaagtacgaaaccggttaaacggaacccgttacgggtcttacggggctttaaccgacccgttagtccgg

SEQ ID NO: 4906 - DNA, 764 bp, Homo sapiens
  misc_feature: GYAE6OF01A00QL.2.78.H01.1.454.CMB.1.raw
  modified_base (198)..(198): a, c, t, g, unknown or other
  misc_feature (198)..(198): n is a, c, g, or t
  modified_base (759)..(759): a, c, t, g, unknown or other
  misc_feature (759)..(759): n is a, c, g, or t
tcagacgctcgacacacgaccggtgctcgatttagtgtgagtagtttgggtttggggcaggagtcagacccagtcaggacacagcatggacatgaggtccccgctcagctctgggctcctgctgctctggttcccaggttccagatgcgacatccagcctgacccagtcctccttcttcgtgtctgcgtctgtgaganacagtacttacatcacgttggtccggacgagtcgaggtacttaagtttacgaacctaacgttacgtccgtaggtactacgaacgtacgaacggtaacggcccggtaggggcccgtaaccgtaacccccccttaaaactccccgtaggtacttaccgttaagtcgggtcgacctagttaccgaacgttcgtacgtaaccggtaaaggttccgggtaccccctagtaccggtaggtttacgacggtaaacggtcgtagggtaggaacgttcgggtacccgggtaattaacggttactttacccgtaactacccttaccgaaacctcgtttaccgaccgggtcccgtccgttaacggcccgtaacggtcccgtaagtaacgttaccttaccgtacgtaaccctttacgtttacttaacgttcggaacctaggttcgtttcgttaacgttcctttcccggttaacccgccttaacggtccggttaccggaccggtaaaccgggtacgtaaaggttacggaacgtacaaacggtaaccgacggttcgacggtccttaacgcccgtnttacg

SEQ ID NO: 4907 - DNA, 870 bp, Homo sapiens
  misc_feature: GYAE6OF01CFH7Z.2.78.H01.1.454.CMB.1.raw
  modified_base (194)..(194): a, c, t, g, unknown or other
  misc_feature (194)..(194): n is a, c, g, or t
  modified_base (269)..(269): a, c, t, g, unknown or other
  misc_feature (269)..(269): n is a, c, g, or t
tcagacgctcgacacacgaccggtgctcgatttagtgtgagtagtttgggtttggggcaggagtcagacccagtcaggacacagcatggacatgaggtcccgctcagctcctgggctcctgctgctctggttcccaggttccagatgcgactatccagctgaccctagtctccttcttacgtgtctgcgtctgngagagaccagacttagatcacgtttgacgggctaagtcaggtatatagtacccaattacgccttggtatacagtnaacggtaacgccgttcgggaccgtaacggtaaccccctaaaaccgtccgttacgacgttaccgtaagtcggttacggacctaacgttaccggtaaaagttcccgttaacggtaaccggtaaaaaggtttccgggggtaacccgtaacgttacggttacgggtttaacccgaaggggaaccgggttccgaagggttaaccggggtactttaccgggtacggggtaaccgtttaacggtaaacctttttaccgggaaccctttaccgtaccctaccgtaaacgtccgtaacgggaaccccggtcccgttaacgccgtacggtccccgttaggaaaccggttaactttcggtaccgtaacccgttaaaccgtttacgtttaaccgtttaacgtacgttaaacggttcgttaccgtttaacggttccgttttaccgtttccccgggtaaccgttccggtaaacccggttttcgggtacccccggaaacggggggttaacccttaaaccgggggttaaagtaaaccggtaaccggtttaacgaaaaccccgggttaaacgtttaccgggtacggttaaccgtaccggtccgtaaacggttaccccg

SEQ ID NO: 4908 - DNA, 917 bp, Homo sapiens
  misc_feature: GYAE6OF01AEZK1.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctcgacccagtcctcctttctttcgtgtctgcgtctgtgagagacagtacttactatctacgttggtcgggcgtagtcgtagggtattaagtttacgtaaccctaaactttacgtcccgttagggtaactcgaagacgtaaggaacggtcccgtacgggggacccgaccgtaaccccccttaaactcccgtaggtacttccgtagttcgggtcgacctaataccgtaaaggtttccgtaggtaacggtaacgggttccggggtacccctaggttaccggtaacgggtttacgaacgggtacgggtaccgtaagggttcggggtaacgttacgggtacggggtaaacgtaacggtttactttttaccccgaccgttacccgttaccaaccccgtagttccccggaaccgggtccccgggttcccgtaaccggcccgtaacggttacccggtaacggttaaacgtttacgtttcgttaaccggtaacccttttaaaccgtttacgttaacgttttacgggttaccgttaacggttacggtttttaccgttaccgttttaaccccgttttcccgttttacccccgggaccggttttaccccggtttaccggggtttaccccgggtaaacccgggtaaacgggggtaaacccggttaaggggttaaacgggtaacgttaacgggttaaaccccggtaaaaccgttaccgggttacgggttaccgggtcccgtaccccgggtaaccttaaccggttaccgg

SEQ ID NO: 4909 - DNA, 734 bp, Homo sapiens
  misc_feature: GYAE6OF01AGN6P.2.78.H01.1.454.CMB.1.raw
tcagacgctcgacacacgaccggtgctcgatttagtgtgagtagtttgggtttgggggcaggagtcagacccagtcaggacacagcatggacatgagggtcccgctcagctcctggggctcctgctgctctggttcccaggttccagatgcgacatccgagcctacgacccagttccttcctttctttcgtgtctgcgtctggtgagagacagtacttatactctacgttggtcgggcgagtacgaggtaattacttacgtaacctaacttacgcccgttaggtactccgagcgaaggacgccgtagggaccgacccgtaccccctaactccgtagacttcgtagtggtcgactactacgtaacgttcgacggtaacggtaacgggttccgggtacccaagtcggtacggttacgaggacggacgtaggtacggtagtcgggtacggtactacgttcttaccgtactacctacgacctagtaccggacgtcccggtacgtacgccgtaaccgtactaacggtagtaccttcgtaccgttaacttacctttagtaactttcggtacgttacggttctttacgttcgtttacccgtttccgttccccggtacgtttccggtaaccgggtttccgggaaccggggaaccgggttaaacggtacggtaaggtaacctaacggtaacccgtaaacggttaacgcgggtaccttaccggaccgttaacctacccggttcg

SEQ ID NO: 4910 - DNA, 867 bp, Homo sapiens
  misc_feature: GYAE6OF01EBWL8.2.78.H01.1.454.CMB.1.raw
  modified_base (168)..(168): a, c, t, g, unknown or other
  misc_feature (168)..(168): n is a, c, g, or t
  modified_base (823)..(823): a, c, t, g, unknown or other
  misc_feature (823)..(823): n is a, c, g, or t
tcagacgctcgacacacgaccggtgctcgatttagtgtgagtagtttgggtttgggggcaggatcagacccagtcaggacacagcatggacatgacgggtccccgctcagcctccgtggggcctcctgctgctccttcgggttcccaggttccagatgcacactccanctacgaccctgttccttcccgttttctttacgtgttcctgtccgttcgtaggtaggaacgacgaacagttaacctttactactacgtacggtttcggccggggagtacgtagaggtaatttaacgttaacgtaaacccttacgttacgtaccgttagttaacgtacgaagacgaacggaaccgtccggtagggaccccgtaacccgtaaccccccgtttaaacgtcctaggtacgtttacgttacgggtggtaccgtaacgtactacggtaacgttccgtaacggtaaccgtaacggggttacccggtaccgtacggttaacgggtcggtacggaacggtacgggtagttacgggtacgtaccgtagggtacgggttaacctacgttaccgttacctcttaacctccgtaaaccgcgttaacggacgcccggtaccgaagcccggttacggaccgttaaggttaaccgttacgttacccgttaacgttaccgtttaaccctttagttaacgtttcgtaacgggttacgtttacggtttactttacggtttacccttttaccgggtccgttacccggtccgttacggggtacccgtacgggtaaaaccgggtaagtaacgggttaaggtaaccggtaacaaaacccgggttaaacncgggttaacggttaccacggttaaccaacccgttcgttacccgg

SEQ ID NO: 4911 - DNA, 158 bp, Homo sapiens
  misc_feature: GYAE6OF02IP5WV.2.78.H01.1.454.CMB.1.raw
  modified_base (154)..(158): a, c, t, g, unknown or other
  misc_feature (154)..(158): n is a, c, g, or t
tcagacgctcgacacacgaccggtgctcgatttagtgtgagtagtttgggtttgggaccaaggtagagatcaaacgaactgtggctgcaccatctgtcttcatcttcccgccatctgatgtcgagcgtctgagcgggctggcaaggcgcatagnnnnn

SEQ ID NO: 4912 - DNA, 508 bp, Homo sapiens
  misc_feature: GYAE6OF02JYD0K.2.78.H01.1.454.CMB.1.raw
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (494)..(494): a, c, t, g, unknown or other
  misc_feature (494)..(494): n is a, c, g, or t
tcagacgctcgacacacgaccggtgctcgatttagtgtgagtagtttgggtttggggcaggagtcagacccagtcaggacacagcatggacatgagggtccccgctcagctcctgggctcctgctgctctggttcccaggttccagatgcgacatccagctgacccagtctccttcttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtgggtccatcgaggttcagaggcagtggatctgggacagatttcactctcaccatcagcgctgcagcctgaagnttcngcaacttactattgtcagtagttctgtattctttcccgcgtcgacgtttcgccgtagggtaccctaagggtacgagacttacgaaacgtactggtacggntcggacaccgtacg

SEQ ID NO: 4913 - DNA, 496 bp, Homo sapiens
  misc_feature: GYAE6OF02F6YLD.2.78.H01.1.454.CMB.1.raw
  modified_base (440)..(440): a, c, t, g, unknown or other
  misc_feature (440)..(440): n is a, c, g, or t
tcagacgctcgacacacgaccggtgctcgatttagtgtgagtagtttgggtttgggggcaggagtcagacccagtcaggacacagcatggacatgagggtccccgctcagctcctgggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattctgcaacttactattgtcagtagttctgtatttctttcccgngtctacgtttggccaggggaccaagggtagagatcaaacgactggtgctgcaccta

SEQ ID NO: 4914 - DNA, 494 bp, Homo sapiens
  misc_feature: GYAE6OF02HN0JO.2.78.H01.1.454.CMB.1.raw
tcagacgctcgacacacgaccggtgctcgatttagtgtgagtagtttgggtttgggggcaggagtcagacccagtcaggacacagcatggacatgagggtcccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcgcctgcagcctgaagattctgcaacttactattgtcagagttctgatttccttccgcgctacgttggccaggggaccaaggtagagatacaaacgacgtgtaggctgacactacg

SEQ ID NO: 4915 - DNA, 538 bp, Homo sapiens
  misc_feature: GYAE6OF02IS8B5.2.78.H01.1.454.CMB.1.raw
  modified_base (399)..(399): a, c, t, g, unknown or other
  misc_feature (399)..(399): n is a, c, g, or t
tcagacgctcgacacacgaccggtgctcgatttagtgtgagtagtttgggtttgggggcaggagtcagacccagtcgaggacacagcatggacatgagggtcccgctcagctcctgggctcctgctgctctggttcccaggttcccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaaactcctgatctatggtgcatcaagtctgcaaagtgggtccatcgagttcagaggcagtggatctgggacagatttcactctcaccatcagcggcctgcagcctgaagattcngacaacttactattgcagtagtttctgtatttcctttcccgcgtctacgtttggcccgtaagggggtaccctaaagggtacgaaggtaacttaccgaaaacggtaacgttggtacggtaccttaggacctaaccctacg

SEQ ID NO: 4916 - DNA, 159 bp, Homo sapiens
  misc_feature: GYAE6OF02IM946.2.78.H01.1.454.CMB.1.raw
  modified_base (155)..(159): a, c, t, g, unknown or other
  misc_feature (155)..(159): n is a, c, g, or t
tcagacgctcgacacacgaccggtgctcgatttagtgtgagtagtttgggtttgggaccgaaggtagagatcaaacgaactgtggctgcaccatctgtcttcatcttcccgccatctgatgtcgagcgtctgagcgggctggcaaggcgcatagnnnnn

SEQ ID NO: 4917 - DNA, 544 bp, Homo sapiens
  misc_feature: GYAE6OF02JS4DE.2.78.H01.1.454.CMB.1.raw
  modified_base (397)..(397): a, c, t, g, unknown or other
  misc_feature (397)..(397): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaattagcctggtatcagcagaagcctgggcgagcccctaaatcctgatctatggtgcatcaagtctgcaaagtgggtcccagtcgaggttcagaggcaggtggatcgtgggacagatttcactctcaccatcagcggctgcagcctgaagtnttcagactaacttactattgacagtacgtttctagtacttttccgttcccgcgtccgtacgtttcggaccgtacggggaacctaagggttaacgaggtaactaaccgaaacggtaccgttggtacggtcctacggtacctacctacg

SEQ ID NO: 4918 - DNA, 546 bp, Homo sapiens
  misc_feature: GYAE6OF02I3BXX.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactccctgatctatggtgcatcaagtctgcaaagtggggtccatcgaggttcagaggcagtggatctgggacagatttcactctcaccatcagcggcctgcagcctgaagattctgcaacttactattgtcagtagttctgtactttctttcccgcgtctacgttttcggcccgtaagggggtaccctaaaggggtacgaaggtaacgttaccgaaaacggtaacgttacggtacgggtccttacggccaacccgtaacg

SEQ ID NO: 4919 - DNA, 591 bp, Homo sapiens
  misc_feature: GYAE6OF02IVLKU.2.78.H01.1.454.CMB.1.raw
tcagacgctcgacacacgaccggtgctcgatttagtgtgagtagtttgggtttgggggcagggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaattagcctggtatcagcagaagcctgggcgacgcccctaaactcctgatctatggtgcatcaagtctgacaaaggtcggggtacccagtcgtaggttcaggaggcaggtggatcgtgggacagtatttcgactctcaccatcagccggcctgcacgcctagaagtcttctacgaccttaaactttactaatttcgtactaagtcgtttctgttactttccttcccgcgtccgtaccggttttcggacccgtaacgggggtacctaaaggggtacgtaaggtaacgttaaccgtaaaaccggtaacgttcgggtacggtaccgttacggacccgtaaccgtaacg

SEQ ID NO: 4920 - DNA, 526 bp, Homo sapiens
  misc_feature: GYAE6OF02IF0AT.2.78.H01.1.454.CMB.1.raw
  modified_base (353)..(353): a, c, t, g, unknown or other
  misc_feature (353)..(353): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcagcccctaaatccctgatctatggtgcatcaagtctgcaaagtggggtcccatcgaggttcagaggcagtggatcgngggacagatttcactctcaccatcagcggctgcaacctgaagattttgctaacttactactgtacaacagtaagttacacgttaccccctgggaccgtttcggaccgaaacgggaccgaaggtaggaaactacgaaacgaactagtacggctagcaccatctcgtccttctac

SEQ ID NO: 4921 - DNA, 590 bp, Homo sapiens
  misc_feature: GYAE6OF02H7VLN.2.78.H01.1.454.CMB.1.raw
  modified_base (185)..(185): a, c, t, g, unknown or other
  misc_feature (185)..(185): n is a, c, g, or t
tcagacgctcgacacacgaccggtgctcgatttagtgtgagtagtttgggtttgggggcgaggagtcagacccagtcaggacacagcatggacatgagggtccccgctcagctcctggggctcctgctgctctggttcccaggttccagatgcgacatccagctgacccagtctccttctttcgngtctgcgtctgtgaagagacagacttacatcacttgcgggcagtcaggatattagtaccaattagcctggtatcagcagaagctgggcgagacccctaaactcctagactctatggtgcatcaagtctagcaaagtgggtacccagtcgagttcagtaggcaggtggaatcgtagggacaggtatttacgacgtctcgaacctagtcaagccggcttcgacaagcccttagaacggtatttctagacctaaactttactagtttgtacctaagacgttttctgtaacttttcccgtttccggacgcttaaccggttttggacccgttaagggggtaccctaaagggtacggtagtaacgttaaccgaaaacggtactacggtggtaccgttagccgtaacctacg

SEQ ID NO: 4922 - DNA, 553 bp, Homo sapiens
  misc_feature: GYAE6OF02GAGWT.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatcgtgggacagatttcactctcaccatcagcggcctgcagcctgaagattctgccaacttactattgtcagtatttctgtactttcctttacccgcgtcctacgttttcgggacccgtaagggggtaccctaaaggggtacgtaacggaacgttaccgaaaaaccggtaacttacgggtcgggacctcgggtaccaccttacg

SEQ ID NO: 4923 - DNA, 542 bp, Homo sapiens
  misc_feature: GYAE6OF02G4326.2.78.H01.1.454.CMB.1.raw
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtgggtccatcgaggttcagaggcagtggatcgtgggacagatttcactctcaccatcagcggcctgcagcctgaagnttcngactaacttactattgtcagtagtttctgtactttccgtttcccgcgtccgtacgtttcgggacccgtaagggggaaccctaagggtaaggacgtaacgtaccgaaaacgtaacgttggtacggtactcggaccaccgtacg

SEQ ID NO: 4924 - DNA, 572 bp, Homo sapiens
  misc_feature: GYAE6OF02IRWYU.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgacaaagtgggtacccatcgaggttcagaggcagtggatcgtgggacagattcactctcaccatcagcgctgcagcctagaagtattctgactaaacttactattgtactagtagttctgtactttccgtttcccgcgtccgtaaccgttttcgggacccgtaagggggtacccgtaaaggggttacggaacggtaacgttaacccgaaaaccggtaaccgttcggtacgggtaccgttacggaccctaacccgtaacg

SEQ ID NO: 4925 - DNA, 532 bp, Homo sapiens
  misc_feature: GYAE6OF02G16US.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcagtcaggatattagtaccaattagcctggtatcagcagaagcctgggcgagcccctaaactccctgatctatggtgcatcaagtctgcaaagtggggtcccatcgaggttcagaggcagtggatcgtgggacagatttcactctcacatcagcggctgcagcctgaagattctgactaacttactattgtcagtagtttctgtactttccttcccgcgtcctacgtttcggaccgtagggggaaccctaaagggtaagaggtaactaccgaaacgtaacgtcggtggtactacggaccaccgtacg

SEQ ID NO: 4926 - DNA, 544 bp, Homo sapiens
  misc_feature: GYAE6OF02GCWA3.2.78.H01.1.454.CMB.1.raw
  modified_base (397)..(397): a, c, t, g, unknown or other
  misc_feature (397)..(397): n is a, c, g, or t
  modified_base (450)..(450): a, c, t, g, unknown or other
  misc_feature (450)..(450): n is a, c, g, or t
tcagacgctcgacacacgaccggtgctcgatttagtgtgagtagtttgggtttgggggcaggagtcagacccagtcaggacacagcatggacatgagggtcccgctcagctcctgggctcctgctgctctggttcccaggttccagatgcgacatcccagctgacccagttctccttctttcgtgtctgcgtctgtgagagacagacttactatcacttgtcgggcgagtcaggatattagtaccaacttagcctggtatcagcagaagcctgggcgagcccctaaactccctgatctatggtgcatcaagtctgcaaagtgggtccatcgagttcagaggcagtggatcgtgggacagatttcaatctcaccatcagcggcctgcagcctgaagtnttctgactaactttactattgtacagtagtttctggtactttccgtttcccgngtaccacggttttcggaccctagggggtaaccctaaagggtacgaggtaacttaccgaaaacgacgttaggtgggacctcggaccgtacctacg

SEQ ID NO: 4927 - DNA, 520 bp, Homo sapiens
  misc_feature: GYAE6OF02HQS43.2.78.H01.1.454.CMB.1.raw
  modified_base (404)..(404): a, c, t, g, unknown or other
  misc_feature (404)..(404): n is a, c, g, or t
  modified_base (451)..(451): a, c, t, g, unknown or other
  misc_feature (451)..(451): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaaactcctgatctatggtgcatcaagtctgcaaaggtggggtcccatcgaggttcagaggcagtggatctgggacagatttcactctcaccatcagcggcctgcagcctagaagattcngtcaaactttactattgtacagtagttctgtactttccgtttcccgngtcctacggtttcggcccgaggggtacccaagggtagaggatacaaacgactggtggctcgcacctacg

SEQ ID NO: 4928 - DNA, 598 bp, Homo sapiens
  misc_feature: GYAE6OF02HZ2MC.2.78.H01.1.454.CMB.1.raw
  modified_base (303)..(303): a, c, t, g, unknown or other
  misc_feature (303)..(303): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagaccaattagcctggtatcagcagaagcctgggcgagcccctaaatccctgactctagtggtncatacaagtctgacaaaggtcggggtacccagtcggaggttcaaggtaggactaggtaggactcgtggggaactaggtactttcgacttctcacctatcgagcggctcgcacgcctagaaagtctttcgtgaccgttaaactttactactttacgtactaaggtacgttttcctagtaccttttccgttccccggacgtaccgttaccgggttttcggacccgtacgggggtaaccaagggttacgaacgtaagtaccgaaacgtacgttggtacggtactcggacctacgtacg

SEQ ID NO: 4929 - DNA, 672 bp, Homo sapiens
  misc_feature: GYAE6OF02HZF6V.2.78.H01.1.454.CMB.1.raw
  modified_base (524)..(524): a, c, t, g, unknown or other
  misc_feature (524)..(524): n is a, c, g, or t
  modified_base (628)..(628): a, c, t, g, unknown or other
  misc_feature (628)..(628): n is a, c, g, or t
tcagacgctcgacacacgaccggtgctcgatttagtgtgagtagtttgggtttggggcgaggagtcagaccagtcaggacacagcatggacatgagggtcccgctcagctcctggggctcctgctgctctggttcccaggttccagatgcgacagtccagctgacccagtctcttcttcgtgtctgcgtctgtagagagacagacttacatactatttggtcgggacgtagtcaaggtattattaccgtaccgaaacttagaccttggtatcaagcagaagtcctggggcaacggaccccttaaaactcccctaggacttacctaagtggttagaccacgtttacgaaacggttctagtaaccgaaaaggttccgggggtaccctaagtaccggtaagggtttaccgaaggtacggacgtaggtagggaacttccggtaggaactaggtaattctaacgtccttacaacccattacgaacggtccgaccttgaccgaagtccgtaagaaacggttactttaccngtaccctaaaagtttccaagtttctaacgtaggtacgtttctaggtacttttcgtttccccgagtacttacggtttcgaccggtaagggtaccaacgggtagtntaaccgtacaaacggtactacggttagcccgttagccctactag

SEQ ID NO: 4930 - DNA, 527 bp, Homo sapiens
  misc_feature: GYAE6OF02HQRUN.2.78.H01.1.454.CMB.1.raw
  modified_base (400)..(400): a, c, t, g, unknown or other
  misc_feature (400)..(400): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtgggtccatcgagttcagaggcagtgatcgtgggacagtatttcactctcaccatcagcggctgcagcctagaagtattcngactaacttactattgtacagtacgttctgtactttcctttcccgcgtccgtacgtttcggaccgtaggggacctaagggtacgagtactaccgaaacgacgttggtacggtctacgaccacctacg

SEQ ID NO: 4931 - DNA, 512 bp, Homo sapiens
  misc_feature: GYAE6OF02FX92P.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaattagcctggtatcagcagaagcctgggcgagcccctaaactcctgatctatggtgcatcaagtctgcaaagtgggtcccatcgaggttcagagcagtggatctgggacagatttcactctcacatcagcggcctgcagcctgaagtattctgctaacttactattgtcagtagtttctgtatttccttcccgcgtctacgtttggccgtaggggacctaagggtacgagtactacgaaacgacgttggtacggctcgccactacg

SEQ ID NO: 4932 - DNA, 494 bp, Homo sapiens
  misc_feature: GYAE6OF02F6JHK.2.78.H01.1.454.CMB.1.raw
tcagacgctcgacacacgaccggtgctcgatttagtgtgagtagtttgggtttgggggcaggagtcagacccagtcaggacacagcatggacatgagggtcccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtgggtcccatcgaggttcagaggcagtggatctgggacagatttcactctcaccatcagcgcctgcagcctgaagtattctgcctaacttactattgtcagtagttctgatttcctttccgcgtctacgtttgccaggggaccaaggtagagatacaaacgactgtagctgcacta

SEQ ID NO: 4933 - DNA, 538 bp, Homo sapiens
  misc_feature: GYAE6OF02IABDN.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagccgtgggcgacgcccctaaactcctgatctatggtgcatcaagtctgacgaaaggtcgggtaccagtcgaggttcagaggcaggtggatcgtgggacagtactttcactctcaccatcgagcgctgcagcctagaatacttcagacctaacttactattgtcagtattctgtactttcctttcccgcgtcttacgggttcgaccggaacggggactaaagggtagaaggtaactaacgaaacgtacgtggtacggctacgaccacctag

SEQ ID NO: 4934 - DNA, 527 bp, Homo sapiens
  misc_feature: GYAE6OF02G2SZY.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggattattagtaccaacttagcctggtatcagcagaagcctgggcgacgcccctaaactcctgatctatggtgcatcaagtctgacaaagtcgggtcccagtcgaggttcagaggcagtggatcgtgggacagtatttcactctacaccatcgagtacgtctaacaacctagaagtatttgactaacttactactgtacaacagagttacactaccctcgctctacgtttcggacggtacgggaccgaggtcgagactacgaaacgaactgtacgctcgacctacctatctgtac

SEQ ID NO: 4935 - DNA, 574 bp, Homo sapiens
  misc_feature: GYAE6OF02I4JKT.2.78.H01.1.454.CMB.1.raw
  modified_base (305)..(305): a, c, t, g, unknown or other
  misc_feature (305)..(305): n is a, c, g, or t
  modified_base (349)..(349): a, c, t, g, unknown or other
  misc_feature (349)..(349): n is a, c, g, or t
  modified_base (399)..(399): a, c, t, g, unknown or other
  misc_feature (399)..(399): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcagtcaggatattacgtaccaacttagcctggtatcagcagaagccgtggcgacgcccctaaactcctgatctagtggtnctatcaagtctgactaaaggtcgggtaccagtcgaggttcaggngactagtggatcgtaggacagtatttcactctcactatcaggtcgctcgnacgctgaagtattcgtagacctaactttactagttcgtactagtacgtttcgtagttcctttaccgtttcccgccgtacgttaccggtttcggaccgttaaggggaccgtaagggtacgaacgtacgtaaccgtaaaaccgtacgttacggtacggccgttacgaccacgtaacg

SEQ ID NO: 4936 - DNA, 803 bp, Homo sapiens
  misc_feature: GYAE6OF02JNT5Z.2.78.H01.1.454.CMB.1.raw
  modified_base (160)..(160): a, c, t, g, unknown or other
  misc_feature (160)..(160): n is a, c, g, or t
  modified_base (357)..(357): a, c, t, g, unknown or other
  misc_feature (357)..(357): n is a, c, g, or t
tcagacgctcgacacacgaccggtgctcgatttagtgtgagtagtttgggtttgggggcgaggagtcagacccagtcaggacacagcatggacatgagggtcccgactcagctcctgggctcctgctgctctggttcccaggttccagatggcgacactnccccgagtcaccacgtctccttcctttcgttcgttcaacgttcgtcgttgtagccgtagacagtacttactatcacgtttgacgggtcaagtcaaggtattagttaacgtaccaacttagaccttggtatcagacgacgtaaggccgtagggccgaacgccccttaaacgtctcccgtaattacggttgaaaacttnacctaacgtacttacgacgtaaccgtagggtacccggtaacggcccttaaagggtttccgaggtacgggtccaaggggttcgaacgttcggagggtactacgggtactttaccgaacgtttctaccgaacccgtactaccgaaccgtaccggtaccgtacggtaccgtacggtacccttacggtaacgtacgttaccgttacggttacgttaacgttaaccttaacgttacgttaccgtacgttaccgtttacgttacgtacgtttaccgtttacccgtttaccgttaccgtttacgggaaccttttacgggggttaccccgtaacggggggttaacccgttaaaccggggttaaaccggttgaaaccggttaaacgttttaccggtaaacggaaaccggttacggttaccggtaacccgttacggttaccgtacccgttaaaccg

SEQ ID NO: 4937 - DNA, 525 bp, Homo sapiens
  misc_feature: GYAE6OF02GHUXG.2.78.H01.1.454.CMB.1.raw
tcagacgctcgacacacgaccggtgctcgatttagtgtgagtagtttgggtttgggggcaggagtcagacccagtcaggacacagcatggacatgagggtcccgctcagctcctggggctcctgctgctctggttcccaggttccagatgcgacatccagctgacccagtctccttctttcgtgtctgcgtctgtgagagacagacttactatcacttgtcgggcagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcgcctgcagcctgaagattctgcctaacttactattgtctagagtttctgtatttcctttcccgcgtctaccggttttggcccgtaagggggaccctaagggtagacggtaactacgaaacgaacttggtaggcctaggaccactacg

SEQ ID NO: 4938 - DNA, 555 bp, Homo sapiens
  misc_feature: GYAE6OF02JF7KV.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttggtcgggcgagtcaggatattagtaccaattagcctggtatcagcagaagcctgggcgacgcccctaaatcctagatctagtggtgcatcaagtctagacgaaaggtcggggtacccagtcggtaggttcaggaggcgaggtggatcgtgggaacagtactttcacttctacacatcgacgccggtacctgccacgcctagaagtcttctcgacctaacttatattgcagtattctgtactttcctccgcgtctagttcggccgaagggtaccgaagggtagacgtaacgtaccgaaacggtaccgttggtaccggacgttacgacctaccgtacg

SEQ ID NO: 4939 - DNA, 711 bp, Homo sapiens
  misc_feature: GYAE6OF02G2F87.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgacaaaggtggggtacccagtcgaggttcagaggcagtggatcgtaggggacaaggtacttttccaacgttcctaccgtaacccctaattaccggaacggtcccgggtccccttcgggacccgaacggtaccccgttaagggaaacggttacttttcccgtacggtacctaaaccttttacgttaacgttttcgttacgtaacggttacgttttccgttacgttaacgtttttcccgtttaccccggtaccgttacccgttacgggtttttaccggggacccggttaaccggggggtaaccccgtaaaggggttaaccggaagggtaaaccgttaacccgaaaaaccggttaaccgttcgggttacgggtaccttccgggtaccctacccgttaacgg

SEQ ID NO: 4940 - DNA, 544 bp, Homo sapiens
  misc_feature: GYAE6OF02JYKO2.2.78.H01.1.454.CMB.1.raw
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
tcagacgctcgacacacgaccggtgctcgatttagtgtgagtagtttgggtttgggggcaggagtcagacccagtcaggacacagcatggacatgagggtccccgctcagctcctgggctcctgctgctctggttcccaggttccagatgcgacatccagctgacccagtctccttctttcgtgtctgcgtctgtgagagacagacttactatcacttgtcggcgagtcaggatattagtaccaacttagcctggtatcagcagaagcctggcgagcccctaaactcctgatctatggtgcatcaagtctgacaagtcgggtccagtcgaggttcagaggcagtgatcgtgggacagtatttcgactctcacatcgagcgacctgcagcctagacgntttacngacctaacttctattcgctagtacgtttctgtactttccgtttcccgacgtcctaacggtttcggaccctagggggtaacccaagggttacgaagtacgttaacaaaccggtactggtacggtcctaggtacccacttacg

SEQ ID NO: 4941 - DNA, 536 bp, Homo sapiens
  misc_feature: GYAE6OF02F6U5Q.2.78.H01.1.454.CMB.1.raw
tcagacgctcgacacacgaccggtgctcgatttagtgtgagtagtttgggtttgggggcaggagtcagacccagtcgaggacacagcatggacatgagggtcccgctcagctcctggggctcctgctgctctggttcccaggttccagatgcgacatcccagctgacccagtctccttctttcgtgtctgcgtctgtgagagacagacttactatcacttgtcgggcagtcaggatattagtaccaattagcctggtatcagcagaagcctgggcgagcccctaaactcctgatctatggtgcatcaaagtctagacgaaagtcggggtacccagtcgaggttcaagtaggcagtggatcgtgggacagtatttcactctacaccatcagcggcctgacagcctagaagtattctagacaacttactattgtacagtattctgtactttccttccgcgtacgtacgtttcggaccgtaaggggacctaagggtaacagaactacgaaaacgacttcggtagactggtaccactacg

SEQ ID NO: 4942 - DNA, 569 bp, Homo sapiens
  misc_feature: GYAE6OF02JLVHD.2.78.H01.1.454.CMB.1.raw
  modified_base (183)..(183): a, c, t, g, unknown or other
  misc_feature (183)..(183): n is a, c, g, or t
  modified_base (412)..(412): a, c, t, g, unknown or other
  misc_feature (412)..(412): n is a, c, g, or t
tcagacgctcgacacacgaccggtgctcgatttagtgtgagtagtttgggtttgggggcaggagtcagacccagtcaggacacagcatggacatgagggtcccgctcagctcctggggctcctgctgctctggttcccaggttccagatgcgacatccagctgacccagtctccttctttcgngtctgcgtctgtgagagacagacttacatcacttgcgggcagtcaggatattagaccaattagcctggtatcagcagaagcctgggcgagcccctaaactcctgactctatggtgcatcaagtctgcaaagtgggtaccatcgaggttcagaggcagtggatcgtgggacagtatttcgacttcgacacctatcaacggccggtcctgaccgacgtccctagaaacgtntttccgtagacctaaactttactaagtttcgtacagtaacgtttctggtaacttttccgtttcccgacgcttaccggtttggaccgaaggggtaccctaaggggtaacaggtaacttaccgaaaaggtacgtcggtaggacctcggactaaccctag

SEQ ID NO: 4943 - DNA, 506 bp, Homo sapiens
  misc_feature: GYAE6OF02FY10A.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttcttcgtgtctgcgtctgtgagagacagacttactatcacttgtcgggcagtcaggatattagtaccaattagcctggtatcagcagaagcctgggcgagcccctaaactccctgatctatggtgcatcaagtctgcaaagtggggtccatcgaggttcagaggcaggtggatctgggacagatttcactctcacatcagcggcctgcagcctgagattctgcaacttactattgtcagtgttactgtatttcctttcccgcgtctacgtttggccgtaggggacctaagggtagagtataccgaaacgtactggtcggctgccacctac

SEQ ID NO: 4944 - DNA, 532 bp, Homo sapiens
  misc_feature: GYAE6OF02FGZAH.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctgggctcctgctgctctggttcccaggttccagatgcgacatccagctgacccagtctccttctttcgtgtctgcgtctgtgagagacagacttactatcacttgtcgggcagtcaggatattagtaccaattagcctggtatcagcagaagcctgggcgagcccctaaactcctgatctatggtgcatcaagtctgcaaagtggggtcccatcgaggttcagaggcaggtggatcgtggggacaggatttcactctcaccatcagcggcctgcagcctgaagattctgccaaacttactattgtcagtagtttctgtatttccttcccgcgtcgtaccgttttgggcccgtaagggggaaccctaaagggtagaggtaactaccaaaacggtactggtacggctggtaccacctacg

SEQ ID NO: 4945 - DNA, 488 bp, Homo sapiens
  misc_feature: GYAE6OF02FXZXZ.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcagtcaggatattagtaccaacttagcctggtatcagcagaagcctgggcgagcccctaaactcctgatctatggtgcatcaagtctgcaaagtgggtccatcgaggttcagaggcagtggatcgtggacagatttcactctcaccatcagcggcctgcagcctgaagattctgcaacttactattgtcagagttctgtattcctttccgcgtctacgttggccaggggacaaggtagagatcaaacgactgtgctgcactac

SEQ ID NO: 4946 - DNA, 507 bp, Homo sapiens
  misc_feature: GYAE6OF02FX4D5.2.78.H01.1.454.CMB.1.raw
tcagacgctcgacacacgaccggtgctcgatttagtgtgagtagtttgggtttgggggcaggagtcagacccagtcaggacacagcatggacatgagggtcccgctcagctcctgggctcctgctgctctggttcccaggttccagatgcgacatccagctgacccagtctccttctttcgtgtctgcgtctgtgagagacagacttactatcacttgtcgggcagtcaggatattagtaccaattagcctggtatcagcagaagcctgggcgagcccctaaactcctgactctatggtgcatcaagtctgcaaagtgggtcccatcgaggttcagaggcagtggatcgtgggacagatttcactctcacatcagtagtctacaacctgaagtatttgactaattactactgtacaacagtacgttaacgactaccccgtccgctacacgtttcggcggaggaccaggtgagtagtacaaacgaacgtgtagctgaccacatctgtc

SEQ ID NO: 4947 - DNA, 618 bp, Homo sapiens
  misc_feature: GYAE6OF02IHZLM.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagctgggcgacgcccctaaactcctgatctagtggtgcatcaagtctgacgtaaaggtggggtcccagtcgaggttacaggaggcaggtggatcgtgggacagtatttcacttctacacatcgagccggcctgccgacgtcctagaacgttacttcgtacgtaccttaacttacttagtttcgtacgtaagttacgtttacttagttaaccttttcccgtttccccggtcgttacccgttacgggtttccgggacccggtaacggggggtaaccctaaaaggggttacggaacggtaacttaaccgaaaaccggtacgttacggtcgggtaccgtacgaccctaacctacg

SEQ ID NO: 4948 - DNA, 544 bp, Homo sapiens
  misc_feature: GYAE6OF02JDUYY.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaagtgggtccatcgaggttcagagcagtggatctgggacagtatttcactctcaccatcagcagtctgctaaccgtgaagtatttcgactaacttactactgtacaactacgtagttactacgtaccccgtggtaaccgttcggaccgtaacgggaccgaaggtacgaaacgtacgaaaccgaacgtacggtacgtcgtacgtaccacctactactcgttaccttaccg

SEQ ID NO: 4949 - DNA, 535 bp, Homo sapiens
  misc_feature: GYAE6OF02IQRND.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcagtcaggatattagtaccaattagcctggtatcagcagaagccgtgggcgacgcccctaaaactcctagatctatggtgcatcaagtctgacaaaggtcggggtccagtcgaggttcagaggcagtggatcgtgggacagtatttcactctcaccatcagcggctgcagcctagaagtattcgtagactaacttactattgtacagtagttctgtactttcctttcccgcgtctacggtttcggccgtaggggaccgaagggtacgagtaactaacgaaacgtacgtggtaggacgtcgaccacctacg

SEQ ID NO: 4950 - DNA, 552 bp, Homo sapiens
  misc_feature: GYAE6OF02IHPEI.2.78.H01.1.454.CMB.1.raw
  modified_base (223)..(223): a, c, t, g, unknown or other
  misc_feature (223)..(223): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttacatcacttgcggnagtcaggatattagaccaattagcctggtatcagcagaagcctgggcgagcccctaaacgtcctgatctatggtgcatcgaaagtctagacaaaaggtcggggtaccagtccgaggttcaaggaggcagtggatcgtagggactagtatttcacttctacaccatacgagcggtctgcagccgtagaagtattctgctaacttactattgtccaagtcttactgtaactttcgtttcccgcgtactacgtttcggaccgaggggtaacccgaaggtaacggagaacgttaaccgaaacgtacgttggacgtcgtacgaccgtacctacg

SEQ ID NO: 4951 - DNA, 669 bp, Homo sapiens
  misc_feature: GYAE6OF02JXZWB.2.78.H01.1.454.CMB.1.raw
  modified_base (185)..(185): a, c, t, g, unknown or other
  misc_feature (185)..(185): n is a, c, g, or t
tcagacgctcgacacacgaccggtgctcgatttagtgtgagtagtttgggtttgggggcgaggagtcgagacccagtcaggacacagcatggacatgagggtcccgctcagctcctgggctcctgctgctctggttcccaggttccagatgcgacatccagctgacccagtcctccttctttcgngtctgcgtctgtgagagacagacttactatcactttgtcgggacagtcaggtattagttagtaccaactttagccttggtattcaagctaaggaacgtccgtagggccgacgacccctaaactcctgacttactagtggtcgactatacgtaacggttcctacggaccgtaaaaggtccgggggtacccctaagttaccgggaagggttttccaagggtaccgggtcgtaaaggtcggaacttccggtagggggcctaagtacttttccacgtttccgactaccatccgtaagccggtcctgtacggaacgtcccgtagtaaacgtctttcgacgacccttaaagtttcttagtttacggtacttacggaacgttcttaggtctttaccgtttcccgacgtcttacgtttcggcccgtaagggtacccaaagggtttcgagtaccgtaacgaaactaccggttagccggtatcgccaacgttac

SEQ ID NO: 4952 - DNA, 813 bp, Homo sapiens
  misc_feature: GYAE6OF02FF393.2.78.H01.1.454.CMB.1.raw
  modified_base (107)..(107): a, c, t, g, unknown or other
  misc_feature (107)..(107): n is a, c, g, or t
tcagacgctcgacacacgaccggtgctcgatttagtgtgagtagtttgggtttgggggcaggagtcagacccagtcaggacacagcatggacatgacgggtccccgntcagctccgtgggctcctgctgctctggttcccaggttccagactgcgacatccagtcctcgaccctagttccttccgtttctttcggtgttcctggtccgttctggtagacgagacctagtaccttacgtactcgtacgtttcgggccgggactacgtacgaaggttacttacgttacgtaacctacgttacgctaggtacacgagaccgtaaggaccgtccggtacgggaccaccgttacccctaacgtcagtactacgttgtatcgatacgtacgtaagtcgtacgaacggtacggggtccgtaactacggtacggtaggtacgaacgggtacggtaccgtaagggtaccgttacgtacgggtaacggttaaccttaccgtttaacccgtttacccaacccgtacccgtttaaacccgacccgtaccggtaccggaacccggtccggttaaccgtaccgtaacgttaacccggtactaaacggttaccttacgtaccgttaacgtacctttaacgttacgttacgttaacgttacgtacgtttccgtttactaccggtttacccgttttaccgggacccttacgggtaccggtttaaccgggtaccgggtaacgtaaacggaaccggttaaacggtacgaaccgttaaaccgtaacgtaaccggtgttaccggtaacggtccttaccggaccttacgttcccg

SEQ ID NO: 4953 - DNA, 557 bp, Homo sapiens
  misc_feature: GYAE6OF02F8DOK.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgacgcccctaaactcctgatctatggtgcatcaagtctgacaaaggtggggtcccagtcgaggttcagaggcagtggatcgtgggacagatttcactctcaccatcagccggcctgcagcctagaacgtattctgacctaactttactattgtacagttagttcttgtacttttcctttcccgcgtccgtacggtttcggccgtaacgggggaccctaaagggtacggaacggtaactaaccgaaaacgtacgttcggtacgggcctcgacccgacctacg

SEQ ID NO: 4954 - DNA, 676 bp, Homo sapiens
  misc_feature: GYAE6OF02ITQSW.2.78.H01.1.454.CMB.1.raw
  modified_base (313)..(313): a, c, t, g, unknown or other
  misc_feature (313)..(313): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttcttcgtgtctgcgtctgtgagagacagacttactatcacttggtcggacgagtcgaaggtatattacgtaccaacttagcctggtatcagcagaacgccgtaggcgacgtcccctaaactcctagatctagtggtnactatacaagtctgacaaaggttcgggccctagtcggtaggttcagaggacaggtgacttcgtagggacaaggtctttaccgacttcctacacctagtacgtacgtcggtcctacgtactacgtacccgtaggtaacgtacgtttacgtacgtaccttaaacgttttaccgtagtttacgttaaccgtaggttacgtttaccgttagtacccgttttcccgtttccccgggacgttaccgttaccgggtttaccggtacccgggtacggggttaaccccgtaaggggttaaccgacggttaaacctaccgtaaaaccgtacggttacggtaccgtaccggttacgtacccgtaccgttaccgg

SEQ ID NO: 4955 - DNA, 720 bp, Homo sapiens
  misc_feature: GYAE6OF02JLUKG.2.78.H01.1.454.CMB.1.raw
tcagacgctcgacacacgaccggtgctcgatttagtgtgagtagtttgggtttgggggcaggagtcagacccagtcaggacacagcatggacatgagggtcccgctcagctcctggggctcctgctgctctggttcccaggttccagatgcgacatccagctgacccagtctccttctttcgtgtctgcgtctgtgagagacagtacttactatcactttgccgggcagtcaggtattaattacggacctaaacttagccgtggtatcagcaagaagcctgggcgagacccctaaactcctggatcgtatggtgctatccaagttcagctaaaggtcggggtacccagtcgaggttccaggaggccaggtcgagttcgtgggtaacaggtactttcgaacgttctacgtaccctagtccgaagggtcggacccttggaccctaaggcccgttacgaaaggtacttttcccgggtaacgacctaaaaccttttaccgtagtttaccgttcggtaaacggttacggtttaccttaggttaaccgtttttccctttaccccgggtaacgtccccgtttaacgggttttccggtacccgggtaacggggggtaaccccgtaaaaggggttaccgaaacggggttaccttaaccggtaaaaaccgggtaacccgttttaggggttaccgggtaccttacccgggtacgtaaccccgtttaaccgg

SEQ ID NO: 4956 - DNA, 558 bp, Homo sapiens
  misc_feature: GYAE6OF02ICG8M.2.78.H01.1.454.CMB.1.raw
  modified_base (185)..(185): a, c, t, g, unknown or other
  misc_feature (185)..(185): n is a, c, g, or t
  modified_base (306)..(306): a, c, t, g, unknown or other
  misc_feature (306)..(306): n is a, c, g, or t
  modified_base (409)..(409): a, c, t, g, unknown or other
  misc_feature (409)..(409): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccgggttccagatgcgacatccagctgacccagtcctccttctttcgngtctgcgtctgtgagagacagacttactatcacttggtcgggcgagtcaaggattattacgtaccaattagcctggtatcagcagaagcctgggcgagcccctaaactctgatctatggtncatcaagtctgacaaaggtcggggtccatcgaggttcagaggcagtagatcgtgggacagtatttcactctacacatcagcgctgcagcctagaagtcttcanactaaacttactattcgtcagtagttctagtactttccgtttcccgctaccgtacggtttacggccgtacggggtaacctaagggtacggaacgaactaaccgtaaaacggtacgtggtacggacgttacgacctacccgtattacccg

SEQ ID NO: 4957 - DNA, 761 bp, Homo sapiens
  misc_feature: GYAE6OF02GDEW1.2.78.H01.1.454.CMB.1.raw
  modified_base (269)..(269): a, c, t, g, unknown or other
  misc_feature (269)..(269): n is a, c, g, or t
tcagacgctcgacacacgaccggtgctcgatttagtgtgagtagtttgggtttgggggcgaggagtcagaccagtcaggacacagcatggacatgagggtcccgctcagctcctggggctcctgctgctctggttcccaggttccagatgcgacatccagctgacccagtctccttctttcgtgtctgtcgtctgtagacgagacagtaccttactatcactttggtccgggacgtagtcaagggtattattacggtaaccaacgttanccgtaggtactcgagtcaggaaacgcgtagggcgaacgacccctaaaacgtcctggtactacctagttcgggtagctaactacgaaggttcctggaacctaaaaggggttcgggaccctagttaccggtaagggttccaaggtaacggaccgtaggttacgggaaattccggggtagggaaacttagggtacgtttttaacaccgttacgtactacccgtaatacgtaaccggtccggtccgtaacggccgacgtccgtacgtaacgtaacgttacgttcgtaacttaacgttaaacttcgttacgttacgacgtttacgtcggttacgtaccttttaccgtttcccgttaccgtaccgtttaccggttttaccgggtacccgtaacggggtaacccggttaaacggtaacgggttaacgtaaacggttaaccgtaaaccggttaaaccggttgggtaaccggtacggtacggttacccgaccgttaaccgg

SEQ ID NO: 4958 - DNA, 525 bp, Homo sapiens
  misc_feature: GYAE6OF02GDDRK.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtccatcgaggttcagaggcagtggatcgtgggacagatttcactctcacatcagcagtctgacaacctgaagttattttgactaacttactactgtacaacagtagttacacgttacccctggtaccgttcggaccgaagggaccaaggtacggaactaacgaaacgacgtggtacggactacgacacctatctgtcttac

SEQ ID NO: 4959 - DNA, 631 bp, Homo sapiens
  misc_feature: GYAE6OF02JORZ2.2.78.H01.1.454.CMB.1.raw
  modified_base (184)..(184): a, c, t, g, unknown or other
  misc_feature (184)..(184): n is a, c, g, or t
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
tcagacgctcgacacacgaccggtgctcgatttagtgtgagtagtttgggtttgggggtcgaggaggtcagaccagtcaggacacagcatggacatgagggtcccgctcagctcctgggctcctgctgctctggttcccaggttccagatgcgacatccagctgacccagtctccttctttcgngtctgcgtctgtgagnacagcttanatcacttgcgggnagtcaggatattagtaccaattgcctggtatcagcagagctgggcgagacccctaactcctcgatctatggtcgcatcaagtctgcgaaaggtcgggtacctagtacgaggttaccagacggtcgaggtcggaacttcggacggggtaacaggtaacttttacgacttaccgttccaacctaacgctacggtccggcctggctacggacccttagaacgttagttcctaggccttaaactttactatttcgtacgagttacgtttctagttactttccgtttccccgagtcccgttaggtttcggtaccggtaacggggtaacgtaaacgggttaggttaaccgaacgttaacccgtaaaacgtaacccggttggttccgggtaccttacggtacccgaacccgttacg

SEQ ID NO: 4960 - DNA, 553 bp, Homo sapiens
  misc_feature: GYAE6OF02HQKFT.2.78.H01.1.454.CMB.1.raw
  modified_base (184)..(184): a, c, t, g, unknown or other
  misc_feature (184)..(184): n is a, c, g, or t
  modified_base (304)..(304): a, c, t, g, unknown or other
  misc_feature (304)..(304): n is a, c, g, or t
  modified_base (405)..(405): a, c, t, g, unknown or other
  misc_feature (405)..(405): n is a, c, g, or t
  modified_base (451)..(451): a, c, t, g, unknown or other
  misc_feature (451)..(451): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgngtctgcgtctgtgagagacagacttacatcacttgtcgggcgagtcaggatattagtaaccaacttagcctggtatcagcagaagcctggggcagcccctaaactcctgactctatggtncatcaagtctgcaaagtggggtacccagtcgaggttcagaggcaggtggatcgtgggacagatttcacttctcaccatcagcggctgcagctgaagattcngaccaatttactatttgacagtagttctagtactttcgtttcccgngtccttacggtttcggacccgtaaggggtaaccctaaagggtaacgacggtaactaccgaaaacggtaaccgttaggtacgggacttacgaccaccttaacg

SEQ ID NO: 4961 - DNA, 722 bp, Homo sapiens
  misc_feature: GYAE6OF02J016Q.2.78.H01.1.454.CMB.1.raw
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
tcagacgctcgacacacgaccggtgctcgatttagtgtgagtagtttgggtttgggggcgaggagtcagacccagtcaggacacagcatggacatgagggtccccgctcagctcctggggctcctgctgctctggttcccaggttccagatgcgacatccagctgacccagtctccttcttcgngtctgctctagtnagagacagtacttactatcacgtttgcggggcagtcagggtatattacgtaccaattagcctggtactcagcagaacgctggacgacgacccctaaacgtcctagactacgtagtaggtcacactacaaggttcctagacgtaaaggtccgggtacccgtagtcgtaagggttccaaggcggtaccgtagggtacgggtacttaccggtagggaaccgttacggtaattttacccgacgtttacgtaccgtaacccctaggtaaccgtaagggttcccgcccgttacggacccttacgggtaacccctagggtaaaggttccctttaacgtaccgtaccttaaaccgtttactaaggttttaccgaacggttaacgtacgttttgtaaccgttacttttaccgtttccggacgttacgtaccgggttttaccggaccggtaacgggtaccgaaaggttacgaaggtaaccttaacggaaacggttaccgttagggtacggtaccgttagggcccctaagtaccgg

SEQ ID NO: 4962 - DNA, 500 bp, Homo sapiens
  misc_feature: GYAE6OF02GOZWN.2.78.H01.1.454.CMB.1.raw
  modified_base (393)..(393): a, c, t, g, unknown or other
  misc_feature (393)..(393): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcggcgagtcaggatattagtaccaacttagcctggtatcagcagaagcctgggcgagcccctaaactcctgatctatggtgcatcaagtctgcaaagtgggtcccatcgaggttcagaggcagtggatcgtgggacagatttcactctcaccatcagcgctgcagcctgagnttctgcaacttactattgtcagtagttctgtactttccttccgctcgtacgtttggccgagggacctaaggtacgagaactcaaacgactgtggtctcgacactacg

SEQ ID NO: 4963 - DNA, 563 bp, Homo sapiens
  misc_feature: GYAE6OF02H3L23.2.78.H01.1.454.CMB.1.raw
  modified_base (308)..(308): a, c, t, g, unknown or other
  misc_feature (308)..(308): n is a, c, g, or t
  modified_base (369)..(369): a, c, t, g, unknown or other
  misc_feature (369)..(369): n is a, c, g, or t
  modified_base (459)..(459): a, c, t, g, unknown or other
  misc_feature (459)..(459): n is a, c, g, or t
  modified_base (478)..(478): a, c, t, g, unknown or other
  misc_feature (478)..(478): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagtacttactatcacttgtcgggcgagtcaggatattacgtaccaacttagcctggtatcagcagaagccgtgggcgacgacccctaaactcctgatctatggtncatacaagtctagcaaaggtcgggtccagtcgaggttcgagaggcagtggatcgtgggacngtatttcacttcacactatcgacggcggtcccgtgaccgacgtccgtagaaagtctttactgacttaacttatagttgactagtacgttntgttactttccgttcccgngtaccgtacggtttcgccggtaacgggaccgtaaaggtcgaagtaactaaccgaaacgtacgtggtcgtcgtcgacctacgtacg

SEQ ID NO: 4964 - DNA, 513 bp, Homo sapiens
  misc_feature: GYAE6OF02HWN1P.2.78.H01.1.454.CMB.1.raw
  modified_base (225)..(225): a, c, t, g, unknown or other
  misc_feature (225)..(225): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttatatcacttgtcgggnagtcaggatattagtaccaattagcctggtatcagcagaagcctgggcgagcccctaaaactcctgatctatggtgcatcagtctgcaaagtgggtccatcgagttcagagcagtggatctggacagatttacactctcaccatcagcgctgcacgctagaagattcacgctaaacttactattgtacagtagttctagtatttccttccgcgcgttacgtttggaccgacggggtaaccaagggtagaagataaccgaaacgtacgtcgtaggctaggccaactacg

SEQ ID NO: 4965 - DNA, 580 bp, Homo sapiens
  misc_feature: GYAE6OF02HKN9G.2.78.H01.1.454.CMB.1.raw
  modified_base (315)..(315): a, c, t, g, unknown or other
  misc_feature (315)..(315): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatctacgttggtcgggcagtcaggtattattacgtacctaacttagcctggtatcagcagaacgccgtgggcgacgcccctaaactcctgactctagtggtanctatcaagttcgtagacgtaaaggtcgggtaccctagtaccggaggttacgaggtaggcgtaggtggactcgtagggactagtacttcactctcaccatcgacgcgctcgacagtccgtagagtactactcgtactaacttacttagttacgtctagttacgtctagttctttccgttccgacgtcgtacggttcgaccgtacgggtaccgtaaggtagacgtaacgtacgaaacgttacgtcggtacgtctacgacctactacg

SEQ ID NO: 4966 - DNA, 530 bp, Homo sapiens
  misc_feature: GYAE6OF02FT8SR.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaattagcctggtatcagcagaagcctgggcgacgcccctaaactcctgatctatggtgcatcaagtctgacaaaggtcggggtccagtcgaggttcaggaggcagtggatcgtgggacagtactttcactctcacatcagcggctgcagcctagaatcttcgtgacctaacttactattgtacagtagttctgtactttcctttcccgcgtcgtacggtttggccgtaggggacctaagggtacgagtaactacgaaacgtactcggtcgctcgacctacctacg

SEQ ID NO: 4967 - DNA, 568 bp, Homo sapiens
  misc_feature: GYAE6OF02IV4CM.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaattagcctggtatcagcagaagccgtgggcgacgcccctaaactcctagatctagtggtgcatcaagtctgacgaaaggtcgggaccagtcgaggttcaggaggcaggtggatcgtaggacagtacttcactcacacctatcgacgcggcctgacgacgcgtaggaactcttcagtacctaacttactattcgtactacgtagttctagttactttccgtttcccggacgtcgttacggttcggaccgtaacggggaccgtaagggtaccgagtaactaaccgaaacgtacgttaggtaccggacgtacgaccgtacctacg

SEQ ID NO: 4968 - DNA, 721 bp, Homo sapiens
  misc_feature: GYAE6OF02HQRXV.2.78.H01.1.454.CMB.1.raw
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (402)..(402): a, c, t, g, unknown or other
  misc_feature (402)..(402): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtcctccttctttcgtgtctgcgttctgtgagagacagtacttactatctacgttggtcggggcgagtcgaaggtatattaagtaacctaacttagcctggtancagcanaagccgtgggacgacgacccctaaaactcctgatcgtatggtncatacaagtcngacgaaaggtcgggtaccagtacgtagttacaggaggcgaggtaggacgttcgtaacgggataacggtntttacgacttctaccgaacctaactaccgacgggtaccggtccctacggacctaacggtcccgtaaaggtaaaccgtacgttttaccgtacggtaacccttaaaacgttttaccttaacgtttacgttaacgtaacggtttacggtttcccttaggtttaccttttcccgtttaccccgggtcgtaacccggtttaccggttttacgggaccccggtaaagggggtaaacccgtaaaggggttaaccgtaaaggtaaccgttaaccgtaaaacccggtagttacgggaccggttaccgtacggtaccgaacccgttacg

SEQ ID NO: 4969 - DNA, 574 bp, Homo sapiens
  misc_feature: GYAE6OF02HLN6G.2.78.H01.1.454.CMB.1.raw
  modified_base (483)..(483): a, c, t, g, unknown or other
  misc_feature (483)..(483): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttacatcacttggtcgggcagtcaggattattagaccaacttagcctggtatcagcagaagcctgggcgagaccccgtaaactcctagatctatggtgcatacgaagtctgacgaaacgtggggtcccagtccgtaggttcagaggcagtggatcgaggacagatttcactctacacactcgaagcggacctgaccacgccgtagaacgtatttccgagacctaaactttactacgttgtactagttacgttctcgtaactttccgttaccccggngtaccgttacggtttcggccgtaacggggacccgaaagggtacgagtaacgtaacgaaacgtactagggtcgtacgtcgaccgaacttacg

SEQ ID NO: 4970 - DNA, 569 bp, Homo sapiens
  misc_feature: GYAE6OF02G1T6P.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgctctgtgagagacagacttacatcacttgtcgggcgagtcaggatattagtaccaacttagcctggtatcagcagagccgtgggcgacgcccctaaactcctgatctagtggtgcatcaagtctgacgtaaaggtcggggtacccagtaccggtaggttcaggaggcgagtggatcgtagggacagtacttcactctcacctatcagcggcctgcgacgcctagaagtattctgacctaacttactattagtacgtaagtacgttacttgttactttccgtttcccgcgtaccgtacgggtttacggacccggtaacggggaccgtaaaggtaacggagtaactacgaaacgtacgtggtacgacgtcgactaccgtacg

SEQ ID NO: 4971 - DNA, 635 bp, Homo sapiens
  misc_feature: GYAE6OF02HCQME.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgcgggcgagtcaggatattagtaccaacttagcctggtatcagcagaagcctgggcgacgacccctaaactcctagactctagtggtgacatcgaagtctagaccgaaaggtcggggtacccagtcggtaggttcaggacggcaggtaggagttcgacgggactagtactttccacgttcctaccgacctattaccgacggtccggtcctaggacctacggtaccgtaggaacgttacgttccgtacgtaaccttaaactttacgtagttcgtacgtacgttacgtttacttggttaccttttccgttcccggaccgtcgttaccggttcggacccggaacggggtaaccgtaaggtaacgaacgtaacgtaaccgaaacgtacgttcgggtacgtacgtacgaccgtacctacgg

SEQ ID NO: 4972 - DNA, 581 bp, Homo sapiens
  misc_feature: GYAE6OF02IBB2X.2.78.H01.1.454.CMB.1.raw
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
  modified_base (372)..(372): a, c, t, g, unknown or other
  misc_feature (372)..(372): n is a, c, g, or t
  modified_base (410)..(410): a, c, t, g, unknown or other
  misc_feature (410)..(410): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttcttcgtgtctgcgtctgtgagagacagacttactatcacttgtcgggcgagtcaggatattagtaccaacttagcctggtatcagcagaagcctgggcgacgtaccccctaaatccctgatctatggtncatacaagttcngaccaaaggtcggggtacccatcggagttcaggaggcaggtggatcgtaggganaaggtctttcactctcaccatcgacgcgacctgcaacnccgtagaagttacttctacgacctaacttactatttgtacagtacgttcttagtacttttccctttcccgactcgttaccggtttcggaccgtaacggggaccaaggggtacgaaggtaccgttaacgaaacggtaacgttcggtacggtacgtaccgacctaccgtaacg

SEQ ID NO: 4973 - DNA, 710 bp, Homo sapiens
  misc_feature: GYAE6OF02HW2U6.2.78.H01.1.454.CMB.1.raw
tcagacgctcgacacacgaccggtgctcgatttagtgtgagtagtttgggtttggggtcgaggagtcagacccagtcaggacacagcatggacatgagggtccccgctcagctcctgggcgtcctgctgctctggttccctacggttccacgatgcgacactcctagcctgaccccagttctcccttcgttttcgtacgtccttgcggtcttggtagatacggactagtactttaacctatccacgttgtcggggacgacgttcaaggtattacttaacggtaaccgaacttagtaccgttaggtacgttcaggacacgtaacgccgtacgggcgaacgtccccttaaaacctccttagacgttactacgtaggtgtcactacgtaacgtctcgtacgaaacggtcggggtcctaagtaccggtacggttacgtaacggtaggacggtacgttaggggacttacggtacgggtaacgacgtaattttccgtaaccgttcgttacaaccgtacgtccgtacggaccgtaccgttcgtaccgacgtctacgaggttaacttcgttacgacttaactttacgatttacgtaccgtaagcgttttacctggtactttcgtttacccgcgtaccgttacgtttcggaccgtacgggtaccgttaaggacggtagtaaccgactaacgaacgttcggcgtacgtcacctacgtacg

SEQ ID NO: 4974 - DNA, 568 bp, Homo sapiens
  misc_feature: GYAE6OF02F0CJQ.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttggtcgggcgagtcaggtatattagtaccaacttagcctggtatcagcagaacgcctgggcgacgacccctaaactccctgatctagtggtgcatcaagtctagactaaggtcgggtcccagtcggaaggttcaggaggacaggtgatcgtgggactagtctttacacttctaccaccatcgacggccggcctgcctagcctagaagtcttctacgacttaaacttctacttcgtacagttagtttctagttactttccgttacccgcgtctacggttggaccggtaggggtaacctaagggtacacgtaaccgtacgaaacggtacgtggtcggtactcgacctacctg

SEQ ID NO: 4975 - DNA, 556 bp, Homo sapiens
  misc_feature: GYAE6OF02IWI2M.2.78.H01.1.454.CMB.1.raw
  modified_base (413)..(413): a, c, t, g, unknown or other
  misc_feature (413)..(413): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttggtcgggcgagtcaggatattagtaccaacttagcctggtatcagcagaagccgtgggcgagcccctaaactcctgatctatggtgcatcaagtctgacaaaggtcggggtccagtcgaggttcaggaggcaggtggatcgtagggacagtatttcactctacaccatcagcggcctgacacgccctagaagtnttcgacgtacctaaactttactagttcgtactagttacgttctcgttactttccgtttcccgcgtacgttacggtttcgaccggtacgggaccgtaagggtacgtagactacgaacgtacgtggtacgtcgtacgactactac

SEQ ID NO: 4976 - DNA, 640 bp, Homo sapiens
  misc_feature: GYAE6OF02JAXD7.2.78.H01.1.454.CMB.1.raw
  modified_base (312)..(312): a, c, t, g, unknown or other
  misc_feature (312)..(312): n is a, c, g, or t
  modified_base (364)..(364): a, c, t, g, unknown or other
  misc_feature (364)..(364): n is a, c, g, or t
  modified_base (493)..(493): a, c, t, g, unknown or other
  misc_feature (493)..(493): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttacatcactttggtcgggcagtcaggatattacgtaccaattagcctggtatcgagcagaagccgtgggcgacgccccttaaacgtccctgattctatcgggtnccaatccaaagttctagacgaaggttcggggtaccagtcgtaggttcgaagngggactaggtggtataccgtgggacaagtctttaccacttctaccacactcgacggccggtccctgccgtagccctaaggaacgttattcctagtaacctaacttttacgtactttagtctaacgggtntttacgtagttacttttcccgtttcccgccgttaccgttaccgttttcggaccccgggaacggggttaaccgaagggttaacgtaggaaccgttaaccgtaaacggtacccgttaggtaccggtcgttaccggaccaacccggttac

SEQ ID NO: 4977 - DNA, 553 bp, Homo sapiens
  misc_feature: GYAE6OF02I8AII.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcagtcaggatattagtaccaacttagcctggtatcagcagaagcctgggcgagcccctaaactcctgactctatggtgcatcaagtctgcaagtcgggtccatcgaggttcagaggcagtggatcgtgggacagtatttcactctacaccatcagcggcctgccagccctaggaactacttcacgtcaaacctttactatttgtacagtattctagtatttccgttccgcgtcctacggtttcggcccgtagggggaaccctaagggtaagagtaacgttaccgtaaaacgtaacgttcggttacgggccttacggacctacctaacg

SEQ ID NO: 4978 - DNA, 697 bp, Homo sapiens
  misc_feature: GYAE6OF02H82QA.2.78.H01.1.454.CMB.1.raw
  modified_base (185)..(185): a, c, t, g, unknown or other
  misc_feature (185)..(185): n is a, c, g, or t
  modified_base (352)..(352): a, c, t, g, unknown or other
  misc_feature (352)..(352): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtntctgcgtctgtgagagacagtacttactatcctacgttggtcggcgagtcgaggtattattacgtaacctaacgttacgccgttagtatcgagcgagaacgtccgtagggccgacgaacccctaaactcccgtagacttctagtcggtacgcaactacgtaagttcncgtaacgtaaacgggtcgggtacctaggtcggtacggttcgaggacggagtagtggaactcggtaggaagtagttacttcctacttacctaccaccgtactaccggacggtccggtacctcggacctacggtacccgtaggtaaacgttctttacgtacgtacccgttaactttacgttaacgtttcgtacgtaaggttcgtttaccgttaacgttacccgttttcccgttacccggcggttaccgttacggtttccgggaccggtaacgggtaacgtaacgggtaacgaacgtaacgtaaaccgaacgtacgttcggtacggtacgtacggtacctaccgtacg

SEQ ID NO: 4979 - DNA, 707 bp, Homo sapiens
  misc_feature: GYAE6OF02HBEDO.2.78.H01.1.454.CMB.1.raw
  modified_base (179)..(179): a, c, t, g, unknown or other
  misc_feature (179)..(179): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtcctccttntttcgtgtctgcgtctgtgagagacagtacttactatctacgttggtcgggctagtcgaaggtatattacgtaacctaacttacgccgttggtatcgaagctaaggaacgcgtgggcgacgacccctaaactccctagactcgtagtggtgacactacagtctagacgtaaaggtcgggtacccagtaccgtaggttaccaggtacggacgtaggtaggtatcggtagggactaggtactttcgacctctaccgactactacgtaggtcccgtccgtgacctaggtacccgttaaggaacgttccgttacgtacgttaacctaaacctttacttattacggttactaaggttacgttttaccgttagtttacccgtttcgttttccccggcgttacccggtttacggttaccggtaccccggggtaaggggtaaccccgtaaagggttaacgggtacttaaaccgtaaccggtaaaaccggtaacggttacggttaccggacgttaccggacccttacccgttaacgg

SEQ ID NO: 4980 - DNA, 563 bp, Homo sapiens
  misc_feature: GYAE6OF02GMV4Q.2.78.H01.1.454.CMB.1.raw
  modified_base (303)..(303): a, c, t, g, unknown or other
  misc_feature (303)..(303): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttccccaggttccagatgcgacatccagctgacccagtctccttctttcgtgtctgcgtctgtgagagacagacttactatcacttgtcgggcgagtcaggatattagtaccaattagcctggtatcagcagaagcctgggcgagcccctaaactcctgatctatggtncatcaagtctgacaaaggtcgggtccatcgaggttcagaggcaggtgatcgtgggactagtactttaccactctacacctagtacacgcggcctgcagcccgtagaagtacttctacgactaacttactattacgtcaagtacgttctacgtactttccttcccggcgtacttaccggtttaggccgaacgggggtaccctaaaggggtacgaagtaactacgaaaaccgtacgtaggtccggactacgacctaccgtac

SEQ ID NO: 4981 - DNA, 580 bp, Homo sapiens
  misc_feature: GYAE6OF02H7X0H.2.78.H01.1.454.CMB.1.raw
  modified_base (349)..(349): a, c, t, g, unknown or other
  misc_feature (349)..(349): n is a, c, g, or t
  modified_base (414)..(414): a, c, t, g, unknown or other
  misc_feature (414)..(414): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttatatcacttgtcgggcagtcaggatattacgtaccaacttagcctggtatcagcagaacgccgtgggcgacgacccctaaactccctgactctagtggtgcatcaagtctgacgaaggtcgggtccagtcgaggtacagnggacagtggatcgaggacagtattcactctacactatcgagcgctgcacgcctagaagtacttcngactaacttactattcgtactaggttcgtttcgtagttactttcccgttttcccggccgtaccgttaccggttcggacccgggtaacggggtaaccgtaagggttaagaacgtaaccgtaaccgaaaccgtaacgttcgggtacggacgtacgaccctacttaacg

SEQ ID NO: 4982 - DNA, 576 bp, Homo sapiens
  misc_feature: GYAE6OF02HBU7E.2.78.H01.1.454.CMB.1.raw
  modified_base (316)..(316): a, c, t, g, unknown or other
  misc_feature (316)..(316): n is a, c, g, or t
  modified_base (417)..(417): a, c, t, g, unknown or other
  misc_feature (417)..(417): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttcttcgtgtctgcgtctgtgagagacagacttactatcacttgtcggcgagtcaggatattagtaccaacttagcctggtatcagcagaagccgtgggcgacgacccctaaactccctagatctatggtgcatcaagtcngacaaaggtcggggtcccagtcgaggttcagaggacagtggatcgtgggactagtatttacactctcaccatcagccggctgcagcctagaacgtattctntacctaaacttactattcgtacgtagtagtttactgttactttccgtttcccggcgtaccgtacggttttcggacccgtacggggtaaccgaacgggttagaagtacgtaaccgaaaaccggtaccgtaggtaccggtacgtacgtaccaacccgtacg

SEQ ID NO: 4983 - DNA, 563 bp, Homo sapiens
  misc_feature: GYAE6OF02HN0BG.2.78.H01.1.454.CMB.1.raw
  modified_base (367)..(367): a, c, t, g, unknown or other
  misc_feature (367)..(367): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttccccaggttccagatgcgacatccagctgacccagtctccttctttcgtgtctgcgtctgtgagagacagacttactatcacttgtcgggcgagtcaggattattagaccaacttagcctggtatcagcagaacgccgtgggcgacgcccctaaactcctgactctatggtgcatcgaagtcagacaaaggtcggggtacccagtcggaggtcaggaggcaggtggatcgngggacagtactttacacctctcaccatccaggccgctgacacgcctagaacgtnttcngacctaacttactattgactagtacgttctagtactttcccgttcccgctacgttaccgtttcggacccggtagggtaacctaagggtacgagtaactaaccgaaacgtacgtacggtggtactacgtccaccctacg

SEQ ID NO: 4984 - DNA, 732 bp, Homo sapiens
  misc_feature: GYAE6OF02F0YJE.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagtacttactatcacttggtcgggcagtcaggatattagaccaattgcctggtatcagcagaagcctgggcgacgacccctaaactcctagactctagtggtgctatacaagtctagacgtaagggtcgggtaccctagtcggtacggttcgaaggacggacgtaggtacggtacgtacggtaggggaactaggttacttttccgtaaccttccgtaccctaaccgtacgttccgacgggtcccggtccgtcggaccgtacggtccgtaaggtaacgttacgttccgtacgtaacccgttaactttacgtttaacgtttcgtaacgtaacggttacgttttcgttacgtttaccgttttcccgtttccccggccggttaccgttaaccggggttttccggggacccgggtaaccgggggttaaacccggttaaaggggttaaccggtaaacggtaacccgttaaaccggtaaaaccggttacggttacgggttaccggtaccggtaccgtacccgtaaccgtttaccgg

SEQ ID NO: 4985 - DNA, 810 bp, Homo sapiens
  misc_feature: GYAE6OF02HOD24.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagtacttactatctacttggtcgggcgtagtcgaggtatattacgtaaccaagttagcctggtatcagcagaacgccgtgggacgacgacccctaaactcccgtagactcgtagtggtcactatactaagtctacgacgtaaacggttcggggtaccctagtaccggtaacggttacgaaggacggtacgtaaggttcggaacgttcggtaacggggaactaacgggttacttttaccgaccgtttaccgtaccaacccgtaagttacccggaacggtcccgggtaccgttacggacccgtaccggtaccgtaacggtaaacggttacgttttacccggacgttaacccttaaaaccgttttacttaaccggtttacggttaaccgtaacggtttaaccgtttaccttacgggttaacctttttaccccggtttccccggaaacggttaccccggttttaaccgggttttccgggaacccccgggttaaagggggggttaaccccttaaaacgggggttaaccggtaaacgttaacccgttaaaccggtaaaccggttaacggttcgggttaccggtaccggttaccgtaccgtaacccgtttacgg

SEQ ID NO: 4986 - DNA, 639 bp, Homo sapiens
  misc_feature: GYAE6OF02HVF07.2.78.H01.1.454.CMB.1.raw
  modified_base (227)..(227): a, c, t, g, unknown or other
  misc_feature (227)..(227): n is a, c, g, or t
  modified_base (309)..(309): a, c, t, g, unknown or other
  misc_feature (309)..(309): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggtccccaggttccagatgcgacatccagctcgacccagtctccttctttcgtgtctgcgtctggtgagagacagacttacatcacttgtcgggnagtcaggatattacgaccaacttagcctggtatcagacagaacgcctgggcgacgacccctaaactcctagatctagtggtncatcaagtctagacgaaagggtcgggtccacgttcggaggttacaggaggctaggtggacgtcgtagggactagtactttacacttactaccgacctagtccgacgtccggtccgtcgaccgacgtcccgtaagaacgttactttccgtagtaacccttaaacgtttacttagtttcgacgtaaggttatttccgtaggttacttttcccgtttacccggcgtaccgttacggttaccggacggtaaccggggaccgttaaaggggtacaacggtaactaaccggtaaaaccgtacggttcggtacggtacctcggtaccgaccttaccg

SEQ ID NO: 4987 - DNA, 624 bp, Homo sapiens
  misc_feature: GYAE6OF02JDPZK.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttcttcgtgtctgcgtctgtgagagacagtacttactatcacttgtcgggcagtcaggatattagtaccaattacgctgtatcagacagaactccgtgggccgaacgaccccttaaaactcctagtactacgtatgggtcacatacgaagtcgtagacgtaaaggtcgggtacccagtacggtacgttacgacggaacggctaggtggaactcggtacgggactaaggtcttttaccgacttactacctaccataccgacgcggtactgacacgtaccgtagtaacgtatcgtactaccttaaacgtctattacgtctaagtacgttcgtattacctttccgttcccgtacgtacctacggtttacggaccgtaacgggtaactaacggggtaacagtaacgaacgtaaaccgtaacggtcggtaccgtagtacggtaccaccgtaacg

SEQ ID NO: 4988 - DNA, 565 bp, Homo sapiens
  misc_feature: GYAE6OF02GADOH.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagccgtgggcgacgacccctaaactcctgatctatggtgctatcaagtctagacgaaggtcggggtccccagtcggtaaggttcagacggcaggtggatcgtgggactagtatttcactcacaccataccgacggcggcctcgcacgcctaggaatcttacgtgtacctaactttacttagttcgtacagttacttctgttactttccgttcccgcgtaccgttacgttcggtacccgtagggaaccgaagggtacgaagtaactacaaacggacgttaggtggactcgacacctacg

SEQ ID NO: 4989 - DNA, 589 bp, Homo sapiens
  misc_feature: GYAE6OF02FMRNL.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcactttgcgggcagtcaggatagttacgtaccaacttagcctggtatcagcagaagccgtgggcgacgcccctaaactcctagatctagtggtgcatcaagtctgcaaaggtcgggtccagtcgaggttcaggaggacaggtggatcgtagggacaggtactttcactctacaccatcgagcggccgtgcacgcctagaagtattcgtgtacctaaacgttactagttgtacaggtacgtttctggttaactttccgtttcccgtcgtccgtacggtttcggccggtaacggggtaaccgtaagggtaacggtacggtaacgttaccgaaaacggtaccgttacggtacgggtctacggtacctacccgttaccg

SEQ ID NO: 4990 - DNA, 531 bp, Homo sapiens
  misc_feature: GYAE6OF02FX3S2.2.78.H01.1.454.CMB.1.raw
  modified_base (393)..(393): a, c, t, g, unknown or other
  misc_feature (393)..(393): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcagtcaggatattagaccaattagcctggtatcagcagaagcctgggcgagcccctaaatccctgatctatggtgcatcaagtctgcaaagtgggtccatcgaggttcagaggcagtggatcgtgggacagtatttcgactctacacctatcagcggcctgccagccngaagtattctgaccaatttactattgtcaagtagtttctgaattttccttcccgcgtcgtaccgtttgggacccgtaaggggtaacccgtaagggtagaacgattacgaaacgtactggttcgctacggacacctacg

SEQ ID NO: 4991 - DNA, 564 bp, Homo sapiens
  misc_feature: GYAE6OF02FL834.2.78.H01.1.454.CMB.1.raw
  modified_base (463)..(463): a, c, t, g, unknown or other
  misc_feature (463)..(463): n is a, c, g, or t
  modified_base (519)..(519): a, c, t, g, unknown or other
  misc_feature (519)..(519): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttggtcgggcagtcaggatattacgtaaccaacttagcctggtatcagcaggaagccgtgggcgacgcccctaaactcctagactctatggtgcatacaagtctgacaaaggtcggggtacctagtcggtaggttacaggaggcgaggtggatcgtgggacagtacttcactctacacatcgagccggctgacacgctaggaatacttcgtgtacctaactttactattgtactagtagttacttnttactttccttcccgcgtcgttacggttcggccggacggggtaacctaagggtaanaacgtacgtaacgaaacgtacgtggtacgctacgaccctactacg

SEQ ID NO: 4992 - DNA, 550 bp, Homo sapiens
  misc_feature: GYAE6OF02FNWVH.2.78.H01.1.454.CMB.1.raw
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
  modified_base (337)..(337): a, c, t, g, unknown or other
  misc_feature (337)..(337): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcattgtcgggcagtcaggatattagaccaattagcctggtatcagcagagccgtgggcgacgacccctaactctgactctatggtncatcagtcngacgtaagtcgggccagtcgaggtcagngcagtgatcgtaggacagtactttcactctcacatcagcgctgcacgcctgaagtctcgtagaccttaacttactacgttgtactaggttacgttctagtactttcccgttacccgtcgtaccgtaccggtttcgaccggtacgggacgtaagggtagtaacggtaattaccgaaacgtacggttcggtacggtaccgtcgtacctacgtacg

SEQ ID NO: 4993 - DNA, 661 bp, Homo sapiens
  misc_feature: GYAE6OF02JO3I1.2.78.H01.1.454.CMB.1.raw
  modified_base (202)..(202): a, c, t, g, unknown or other
  misc_feature (202)..(202): n is a, c, g, or t
tcagacgctcgacacacgaccggtgctcgatttagtgtgagtagtttgggtttggggcaggagtcagacccagtcaggacacagcatggacatgagggtcccgctcagctcctggggctcctgctgctctggttcccaggttccagatgcgacatccagctgacccagtctccttactttcgtgtctgccgttctagtgagngacagtacttacatcacgttgcgggctagtcgaggattagttgaacccaattacgccgtaggtatcgagcaagacgcctggcgacgacccctaaactccgtacgattccgtatcggtcgactactcgtaagtctagacgtaaaggtcgggtacccagtcgaaggttcaggtagcgaggtcgatcgtaggtacacgtactttaccgacttctaccactagtcgagaccgtcgtacgcacgtccgtagaacgtctttcgacgtaaccttaacttctacgtttacgcgttacgtacgtttcgtaacgttccgtttaccctttacccggcgttaccgttaccgggtttaccggcccggtaaccggggttaaccctaaacggggttactaacgggttaaccttaaccggtaaaaccggtaacgttcgggtacggtcccgttacgtaccccgtaacgttaaccgg

SEQ ID NO: 4994 - DNA, 577 bp, Homo sapiens
  misc_feature: GYAE6OF02GKOV7.2.78.H01.1.454.CMB.1.raw
  modified_base (185)..(185): a, c, t, g, unknown or other
  misc_feature (185)..(185): n is a, c, g, or t
  modified_base (422)..(422): a, c, t, g, unknown or other
  misc_feature (422)..(422): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtntctgcgtctgtgagagacagtacttactatcacttggtcgggcagtcaaggtatattagtaccaacttagcctggtatcagcagaacgccagggcgacgacccctaaactccgtagatctagtggtcgcatacaagtctgactaaaggtcgggtccatcgagttcgagaggcaggtgagtcgtggacagtacgttcactctacacctatcgacgcgtcctgacacgacctagaacgnttacgcgtacctaacgttatattcgtactagtcgttcttcgtactttcccgttccgcgtacgtaccgttggtacccgacggggtaaccgaaggttacggtaactacgtaaccgtaaacggtaaccgttcggtaccgcgtacgaccctaacgtacg

SEQ ID NO: 4995 - DNA, 589 bp, Homo sapiens
  misc_feature: GYAE6OF02FLWDZ.2.78.H01.1.454.CMB.1.raw
  modified_base (326)..(326): a, c, t, g, unknown or other
  misc_feature (326)..(326): n is a, c, g, or t
  modified_base (441)..(441): a, c, t, g, unknown or other
  misc_feature (441)..(441): n is a, c, g, or t
tcagacgctcgacacacgaccggtgctcgatttagtgtgagtagtttgggtttgggggcagggagtcagacccagtcaggacacagcatggacatgagggtcccgctcagctcctgggctcctgctgctctggttcccaggttccagatgcgacatccagctgacccagtctccttctttcgtgtctgcgtctgtgagagacagacttactatcacttggtcgggcagtcaggtattattagtaccctaacttagcctggtaatcagcagaagccgtgggacgacggacccctaaacgtcctagatctaatggtgctatacaagtntgacaaggttcggggtaccagtcgaggttcaggaggtcaggtggatcggtgggacgagtattttccactcctaccaacctcgtcaggccggtcctgcacggccctaggaacgttnttctacgactaacgttactatttcgtatagttacgttacttagtactttcccttccgccgttccgtacggtttcggaccgtaacggggactaaagggagtaacgtacttaaccgaaacgtacgttcggagttactcggaccaactacg

SEQ ID NO: 4996 - DNA, 612 bp, Homo sapiens
  misc_feature: GYAE6OF02I1VI9.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttggtcgggcgagtcaggatattacgtaccaacttagcctggtatcagcaagaagcccgtgggcgacgtacccctaaactcctgatctagtggtcgcatcaagtctagacgtaaggtcgggtacccagtcggtaggttcgaaggtacggctaggtggactacggtgggactaggtactttcacctctaccaacctagtaccgacggccggtaccgtgcgtacgtccgtagaattctacgtcgtactaactttactagttcgtacgtaagttcgttacgtacgttacgttcccgttacccggcgtaccgttacggtttaccgggaccggttaacggggaacctaagggtacgaacgtaactacgaaacgtagtcggtacgcgtacgaccctatacg

SEQ ID NO: 4997 - DNA, 561 bp, Homo sapiens
  misc_feature: GYAE6OF02G5EXU.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactccctgatctatggtgcatcaagtctgcaaagtcgggtccagtcgaggttcagaggcagtcggatcgtgggacagtatttcactctacaccatcagcgcctgccagccctagaagactttcagacctaaacttactattcgtacagtacgtttctagtactttccgtttcccgacgttctaccgtttcggccgtaagggggtaccctaagggtagaacgtaacgttaccgtaaaccgtacgtacggtaccggcgttacggacctaccgtaacg

SEQ ID NO: 4998 - DNA, 647 bp, Homo sapiens
  misc_feature: GYAE6OF02IAL5N.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctccgtggggctcctgctgctctggttcccaggttccagatgcgacatccagctcgacccagtcctccttctttcgtgtctgcgtctgtgagagacagtacttactatctacgttggcgggcagtcaggattattacgtaacctaacttagcctggtatcagcagaagccgtgggccgacgacccctaaatcctagactctagtggtgcatacaagtctgacgtaaaggtcggggtaccctagtcgtaaggttcaaggtaggctaaggtcggaactcgtagggaactaggtactttacgacttcctacgaacctatccgacggtccggccttcggactaacggtccgttaaggtaaactagtttaccagtaccttaaactttactacgtttcgtaacgtaaggtaacgtttccgttagtaccttttcccgttcccgcgtaccgttacggtttcggacccgggtaacgggtacccgaaagggttacgacggtaacttaacgaaacggtactcggtcggtacctcggacctaccgtacg

SEQ ID NO: 4999 - DNA, 813 bp, Homo sapiens
  misc_feature: GYAE6OF02HYAK2.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtcctccttctttcgtgtctgcgtctgtgagagacagtaccttactatcctacgttggtcgggacgtaggtcaaggtaattaagttacgtaacctaacgttacgccgttggtaactcagacagaacgccgtagggcgacgtacccctaaactccgtagacttcgtagtggtgacactacgaagtcagacgaaggtccgggtaccagtacggtacggttagaggagactaggtaggactcggtagggactaggttactttaccaccgttactaccaaccctaacgtccgaaccggcccggtaccttaggacccgtacggtaacccgttaaggaaaacgttacgtttaccgtaacgttaaaccctttaaacccgtttaacgtttaaccgtttacggttaaccgttaaggttaccggttttaccgttaggttttaccctttttcccggtttacccccggtacggttaacccgggttttaaccggggttttacccgggaccggggttaaaccggggggttaaacccgtaaagggggttaaaccgggtaaacgttaaaccggttaaaaccccggttaaaacgggttaaccggtttccggggttaaccgggttaacccggtaacggttacccgtaaaccgtttaacccgg

SEQ ID NO: 5000 - DNA, 624 bp, Homo sapiens
  misc_feature: GYAE6OF02GKAOW.2.78.H01.1.454.CMB.1.raw
  modified_base (177)..(177): a, c, t, g, unknown or other
  misc_feature (177)..(177): n is a, c, g, or t
  modified_base (361)..(361): a, c, t, g, unknown or other
  misc_feature (361)..(361): n is a, c, g, or t
tcagacgctcgacacacgaccggtgctcgatttagtgtgagtagtttgggtttgggggcaggagtcagacccagtcaggacacagcatggacatgagggtccccgctcagctcctgggctcctgctgctctggttcccaggttccagatgcgacatccagctgacccagtctccttnttcgtgtctgcgtctgtgagagacagacttactatcacttgtcgggcagtcaggatattagtaccaacttagcctggtatcagcagaacgcctgggcgacgcccctaaaactcctgactctatggtgacatcaagtctagacaaaggtcgggtacccatcggaggttccaagaggcaggtcggntcgtgggacagtatttcactctcacatcagccgctgcagtccctaggaactcgttactacgtacctaaacctttacctagtttacgttacgtaacggtacgttttccgttagttaacgtttttcccgtttccccggtacgttccgtacccgggtttttacggaccccgttaacggggggtaaccctaaagggttaacggacggtaactaccgtaaaaaccgtacgttagggtaccgtacggtaggtaccctaacccgttaccg

SEQ ID NO: 5001 - DNA, 588 bp, Homo sapiens
  misc_feature: GYAE6OF02G36P6.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtcctccttctttcgtgtctgcgtctgtgagagacagacttactatcacttgtcgggcgagtcaggatattagtaccaattagcctggtatcagcagaagcctgggcgagcccctaaactcctgatctatggtgcatcaagtctgacaaagtcgggtccagtcgagttcagaggcagtggatcgtaggacagtattcactctcacatcagcgcctgctacgcctagaacgtacttcgtacgtactaaacctttacttagtttcgttactaacggtacgttttacctagttacttttcccgttttcccgcggtaccgttaccgggttttcggacccggtaaggggtaaccctaaaggggtacgtaaggtaacttaaccgaaaacgtaacgttcggtaggtcgtacggtaccaaccgtacg

SEQ ID NO: 5002 - DNA, 700 bp, Homo sapiens
  misc_feature: GYAE6OF02GUZ42.2.78.H01.1.454.CMB.1.raw
tcagacgctcgacacacgaccggtgctcgatttagtgtgagtagtttgggtttgggggcaggagtcagacccagtcaggacacagcatggacatgagggtcccgctcagctcctgggctcctgctgctctggttcccaggttccagatgcgacatccagctgacccagtctccttcttcgtgtctgccgtctgtgagagacagtaccttacgtatcctacgttcggtccgggcgtaacgtcgagggtattaagttaacgtaaccctaacgttacggccgttggtatcaagcgaagaacgccgtgggcgacgtacccctaaactccgtagtactcgtagtcggtcgacactacaacgttcgtagacgtaaacggtcggggtacctagtcggtaggttacgaggacggcgtaggtggtagtacggtaggactaagtacgtttccaccgttcctaccgaacctacgtacgacggtcccgtacgtcgaccgtacgtccgtagaaacgttcgtttacgtacgtaccttaaactttacctagtttacgcgttaacggtcgtttcgtacgtaccgttttccgttacccggcgtaccgttaccgggtttccgaccgggttaacgggtaaccggtaagggtaacgtaacggtaacgtaaccgtaaaccggtacgttacggtggtaccgtacgtacccgtaccgttacgg

SEQ ID NO: 5003 - DNA, 708 bp, Homo sapiens
  misc_feature: GYAE6OF02H4G0U.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagttcctcctttctttcgtgtctgcgtctgtgagagacagtacttactatctacgttggtcgggcgtagtcaaggattattacgtaccaattgccgtggtactcagacagaacgcgtgggacgacgacccctaaactccctagacttacgtagtggtcgactactacgtaacgtcgtaggacgtaaaagggtcggggtaacccctaggtaccggtacgggttacgaggtaacggacggtaacggtggaacgttcggtacggggactagttactttaccgacttcctacaaccgtacgtccgtacggtccggtccgttacggaccgtaccggtaccgtaaggtaacgttacgtttcgtacgtaaccttaaacgtttacttaacgtttacgtacgttaacggttacgtttacttacgtttacttttcccgtcccggttcgtaccgttaccgtttaccgggaccggtaacggggtaccgtaaaggtacggtacgtaacgttaaccgaacggtcgtacggtcgtacgtacgtaccgaccttacg

SEQ ID NO: 5004 - DNA, 702 bp, Homo sapiens
  misc_feature: GYAE6OF02IJ126.2.78.H01.1.454.CMB.1.raw
  modified_base (104)..(104): a, c, t, g, unknown or other
  misc_feature (104)..(104): n is a, c, g, or t
tcagacgctcgacacacgaccggtgctcgatttagtgtgagtagtttgggtttgggggcaggagtcagacccagtcaggacacagcatggacatgagggtcccnctcagctcctgggctcctgctgctctggtcccaggttccagatgcgacatccagctcgacccagttccttccttctttcgtgtctgcgttctggtgagagaccagtaccttatactctacgttggtaccggggcgtacgtcgaaggtacttaagttaacgtaacccaacgttaacgtccttggttactacgacggcaagaaacgtccgtgggtaccgacgtacccctaaaactccgtagtagttacgtactggtcgtaccaacgttcaaacgttcgtacgaacgtaaacgggttcgggtacccaaggtcggtaaggttacgaaggtacggcgtaaggtcgaagttcggtaggactagtacttctacttactacgacctacgtcgacgcggtaccttgctagtaccgtgaagttaacgtctacgtaaccttaaaccttacgtacttacggtccgtaaggttacgttacgtcgttaacgtttcccgtttacccggtcttaccgttacggttcgggtacccggagggaaccgttaaggacggaacggtaacgtaaccgtaaaacggtcgttacggccggttacgtacggccttaacgtacg

SEQ ID NO: 5005 - DNA, 791 bp, Homo sapiens
  misc_feature: GYAE6OF02GN4SO.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttggtcggcgagtcaggatattagaccaacttagcctggtatcagcagaagccgtggcgacgccctaaactcctgatactatggtgacattcaagttctaggacaaaaggttcggggtaccctaacgttcggtaacgggttaccgaaggtagggactaagggtacggactacggtacggggaactaaggtaacgttttaccaaccgtttccgtaccgaaaccctagttaccgaacgggtcccgggtcccgttacggaccgtaaccggtacccgtaaggtaaacgttacgtttacccgtacggtaacccttaaaccgttttaaccttaagtttacggttaccgaacgtttacgttttaccgttaacggtttaaccgttttcccgttttaccccggtacccgttacggtttaaccccgggtttttacggggacccccggggttaacgggggtaaaccccgggttaaaggggttaaaccgggaaacggttaaaccggtaaacccgttaaaaaccgggtaaccggtttcgggttaccggggaccgtttaaccgggaaccccgttaaccgttaacccgg

SEQ ID NO: 5006 - DNA, 705 bp, Homo sapiens
  misc_feature: GYAE6OF02H80TL.2.78.H01.1.454.CMB.1.raw
  modified_base (131)..(131): a, c, t, g, unknown or other
  misc_feature (131)..(131): n is a, c, g, or t
  modified_base (194)..(194): a, c, t, g, unknown or other
  misc_feature (194)..(194): n is a, c, g, or t
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (514)..(514): a, c, t, g, unknown or other
  misc_feature (514)..(514): n is a, c, g, or t
  modified_base (540)..(540): a, c, t, g, unknown or other
  misc_feature (540)..(540): n is a, c, g, or t
tcagacgctcgacacacgaccggtgctcgatttagtgtgagtagtttgggtttgggggcaggagtcagacccagtcaggacacagcatggacatgagggtccccgctcagctcctgggcctcctgctgctntggttcccaggttccaggtatcgcgacatccagctcgacccagtcctccttctttgacgttcngcttctagtcgaagcgacncggtaatttacntcctacgttggtcgggacatcgtaaggtacttaagttcgaacaattacgctaggtatcagccgtagaacgtccgtaggaccggacgtacccgtaaacgtccgtaggtactcgtaatggttcgacgtactacgtaagttcctaggtaccgtaaggtccgggtacccgtaggtaacggtacgggtttacgaagggtaacggtacggtacgttacgggtacgttacggaacgggtacgtaagttcgttaacgttcctaccgtacgaccctacgacgtacggaccgtcgtacncgtaccgactacggaacgtagttacngtactaacgttactacgttgaccgttagtacgttccgagttaccgttacgtttcccggtagtccgttaacccgttggtacccgtagggtaaccgaagggttaaccctggtaacctaacggtaaccgtacgttacggtaccgttacgaccgttacgaccgttaccg

SEQ ID NO: 5007 - DNA, 581 bp, Homo sapiens
  misc_feature: GYAE6OF02GTYXO.2.78.H01.1.454.CMB.1.raw
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
tcagacgctcgacacacgaccggtgctcgatttagtgtgagtagtttgggtttgggggcaggagtcagacccagtcaggacacagcatggacatgagggtccccgctcagctcctgggctcctgctgctctggttcccaggttccagatgcgacatccagctgacccagtcctccttctttcgtgtctgcgtctgtgagagacagtacttactatctacttggcgggcgagtcaggatattacgtaccaacttagcctaggtatcagcagaagccgtgggcgacgaccccctaaactcctagatctatggtnacatcaagtctgacgtaaaggtcgggtcccagtcgtaggttcagnggcagtgatcgtgganagtattcactctcacatcgagccggctgacctagtcctagaagtctttcgacgtactaactttacgtatttcgactaagttcgttcttacgttactttcccgtttcccgtccgtaccgttaccggtttcggacccggtaaggggaacccgtaaggtaacggagtaacgtaacgaaacggtacttgggtacgtacgtacgacctactcg

SEQ ID NO: 5008 - DNA, 747 bp, Homo sapiens
  misc_feature: GYAE6OF02IFKHM.2.78.H01.1.454.CMB.1.raw
  modified_base (173)..(173): a, c, t, g, unknown or other
  misc_feature (173)..(173): n is a, c, g, or t
  modified_base (186)..(186): a, c, t, g, unknown or other
  misc_feature (186)..(186): n is a, c, g, or t
tcagacgctcgacacacgaccggtgctcgatttagtgtgagtagtttgggtttgggggcaggagtcagacccagtcaggacacagcatggacatgagggtccccgctcagctccgtggggcctcctgctgctctggttcccaggttccagatggcacatccagcctcgacccngttccttcctttntttcgtgtctgcgttctgtgagagacagtaccttatactctacgtttgggcgggcgtagtacgaaggtattattacgaacctaacgttgccgttaggtactcgagacaacgacggtccgtgggaccacgaccccttaatcccgtgtactcgttacgtggttcgactacgtacgtaacgttcgacgtaacgtaacgggttccgggtacctacggtacggtaggttacgaaggtacggtacgtaacgggttcggtaacgttccggtaacgggaactacggtttacctttaccgtaacccttaccgtacctaaccctacggtacccgaacgggtcccggtacccgtacggaccgtaccggtaccgttaaggtaaacgttccgttaccgttacgtaaccttaactttacgtaacgttgtaacgtagttactttcgttacgttacctttccgttcccgtacggttccgttacgggttccggaccggaaccgggtaacggtaacggtaacggaacgtaaccgtaaccgaaacggtcgttacggtccgtacgtccgtaccgtacgtcg

SEQ ID NO: 5009 - DNA, 763 bp, Homo sapiens
  misc_feature: GYAE6OF02G31SK.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctccgtggggctcctgctgctctggttcccaggttccagatgcgacatccagctagacccagttccttccttctttcgtgtctgtcgtctgtgagagacagtacttactatcctacgttcggtcgggacgagtacaggtattaattacgtacctaacttagcctagtatcagcagaacgcgtagggacgacgtacccctaaactcctaggacttacgtagttgggtgacgtactacgtaaacgttcgtagtaaccgtaaacggggttccgggggtacccaggttcggtacggttacgaagggtacggacgtaggtacgggtacttcggtacggggacgtaaggttacgtttccgtacctacgtacccgtaaaccgtcgttaacccggaacggtcccggtctacgggtacccacggtaccttaacgggatttaaccgttccgtaacggttaacctaaaccgtttacgttaagttccgttaacggtacgtttaggtttacctttagtacctttttacccgttcccggtacgtttaccggttaccgggttaccgggacccgggtaggggtaacccggtaaagggttacggtaaactaacggtaacccggtaaagttaccggtcggtaaccgtcggtaacgtcccgtaaccgttacg

SEQ ID NO: 5010 - DNA, 794 bp, Homo sapiens
  misc_feature: GYAE6OF02JROUZ.2.78.H01.1.454.CMB.1.raw
  modified_base (184)..(184): a, c, t, g, unknown or other
  misc_feature (184)..(184): n is a, c, g, or t
  modified_base (409)..(409): a, c, t, g, unknown or other
  misc_feature (409)..(409): n is a, c, g, or t
  modified_base (543)..(543): a, c, t, g, unknown or other
  misc_feature (543)..(543): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctcggttcccaggtttcccagactcggacgacatcccgagccttcggaaccccngttccttccctttctttaccggtgtctggccgtcttggtagaggtacgaacgacgtaactttaccgtattaccgtaaccgtttcggtccggggaccgtaggtaccgtagggtaactttaaccggttacgttaacccgttaaacgttaacggtccgttaggtacttacgagtacgtagaacgtccgaggtccgacgtacccctaaactccgtcattcgtatcggtnacgtatcgtaagcgttagaccgtaaggtcggttaccctagtaccggtagttccgaagacgggctaggtaggtagtcgaggtaacccgagttaccgttactaccttaccgtaccactacgtaccgaggtacccgngtccggccgtacggtacccgtaaggttaaaccgtccgttacttaacccgggtaccttaaacgtttacctttacgggttacgttaaccgtacgtttaaacccggttttccggtacgtttaccgtttcccgttacccgggtaaccgtcccgtttacgttaccgggtaccgggtaacggtaacccgttaaggaacggtacgtaaccgtaaccggtacgtaacgttcggtacgtaccgacgtaccctgtaaccgg

SEQ ID NO: 5011 - DNA, 574 bp, Homo sapiens
  misc_feature: GYAE6OF02GYGW7.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttggtcgggcgagtcaggatatagtaccaacttagcctggtatcagcagaagcctgggcgacgcccctaaactcctgatctatggtgcatcaagtctgacaaaggtcgggtccagtcgagttcaggagcagtggatgtagggacagtatttcactctacacatcagcggctgcgagcctagaactattcgtcgactaaactttactattcgtagtaacgtagttcttaggttaaccttttcccgtttaccccgcggttaaccgtccggtttacggacccggtaaggggaaccctaaggggtaacgtaagtaacttaaccgaaaacgtacgttaggtacggtctacgacctacgtacg

SEQ ID NO: 5012 - DNA, 533 bp, Homo sapiens
  misc_feature: GYAE6OF02GU01W.2.78.H01.1.454.CMB.1.raw
  modified_base (181)..(181): a, c, t, g, unknown or other
  misc_feature (181)..(181): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
tcagacgctcgacacacgaccggtgctcgatttagtgtgagtagtttgggtttggggcaggagtcagacccagtcaggacacagcatggacatgagggtcccgctcagctcctgggctcctgctgctctggttcccaggttccagatgcgacatccagctgacccagtctccttctttcgngtctgcgtctgtgagagacagacttacatcacttggcgggcagtcaggatattagtaccaattagcctggtatcagcagaagcctgggcgagcccctaaaactccctgactctagtggtgcatcaagtctgcaaagtgggtcccatcgagttcagaggcagtgatcgtgggacagtatttcgactctcacatcagcggcctgcagcctagaacgnttcngactaacttactattgtacagtgttctgtatttccttccgcgtactacggtttcggccgtaaggggaccctaagggttacgacgtaactaccgaaaacgacgttggtaacggtccgtagtacccgaacttacg

SEQ ID NO: 5013 - DNA, 771 bp, Homo sapiens
  misc_feature: GYAE6OF02FKJVP.2.78.H01.1.454.CMB.1.raw
  modified_base (216)..(216): a, c, t, g, unknown or other
  misc_feature (216)..(216): n is a, c, g, or t
tcagacgctcgacacacgaccggtgctcgatttagtgtgagtagtttgggttgggggcaggaggtcagacccagtcaggacacagcatggacatcgagggtccccgctcagctcctggggctcctgctgctctggttcccaggttccagatgcgacatccagctgacccagtcctccttctttcgtgtctgcgtcgtgtgagagacagacttacanctacttgacgggcgtagtccaaggacttaagttaggtaccaacttacgaccgttaggtatccgagactaacggaacgtacccgtgggccgaaccgtaccccctaaaaccgtccctaggtaactccgttaagtggtcggacctacgtacaaacgttcgtacggaccgtaaaggtaccggggtccctaacgtcggtaacggttacgtagggaacggtaacgtagggttaggtaacttacgtacgggtaacgtaacggtacttttaccgaacttccctaaccaacccgtacgtacgaggtacccgggtccctaggtacccttaggtcccgttaacgaaagttacgtttaccgtacgtaaccgtaaacctttaacgttaacgttacgttacggttacgttacgtttaccgttagttacccgttttacccgttcccggtaccgtaaccgttaccggtttacgggacccgtaacggggaaaccgtaacgggtaacgtacgtaaccgtaaccgtaaacggtaacggttaggtaccgtcggtaccgtacccgaaccttacccg

SEQ ID NO: 5014 - DNA, 734 bp, Homo sapiens
  misc_feature: GYAE6OF02IX761.2.78.H01.1.454.CMB.1.raw
  modified_base (185)..(185): a, c, t, g, unknown or other
  misc_feature (185)..(185): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtcctccttctttcgngtctgcgtctgtgagagacagtacttactactctacgttggtacgggcgtagtccgaggtaattaagtttacgtaacctaacgtttacgcccgttagggtaactcaggaccgtaagaacggccgtggggaccaaccggtaccccctaaactcccgtagacttccgtagtcggtacgacgtatacgtaagtcgtagacgtaaagggtccggtacctagtaccggtagttacgaggtacggtacgtaggtacgaacttcggtagggaactaggttacttaccacgtacctacgtaacctacgtacggacggtcccgaccgtacgtaccggacgtaccggtacgtaaagttcttccgtaacgttaccttaaacgttacgttagttacggaacgtagttacgtttccgttaacgttcctttcccggtttacccgtgtaaccgttacgggtttaccggaccggttaaaccggggtacgtaaacggtacgtacggtaaacctaacccggtaagttacccggttagggaccgttccgtaaagtcccgtaacgttcg

SEQ ID NO: 5015 - DNA, 808 bp, Homo sapiens
  misc_feature: GYAE6OF02IQEUL.2.78.H01.1.454.CMB.1.raw
tcagacgctcgacacacgaccggtgctcgatttagtgtgagtagtttgggtttgggggcaggagtcagacccagccaggacacagcatggacatgagggtccccgctcagctcctggggctcctgctgctctggttcccaggttccagatgcgacatccagctcgaccagtctccttctttcgtgtctgcgtctgtgagagactacgtacttactatctacgttcggtcgggacgtagtacgaggtattagttacggtaacctaacttacgcccgttaggtactcgagtactaaggaaacgtccgtacggggcgaaccggtacccctaaaaccttccgtacgacttcgtagtcgggtacgtctaacgtcctaaacgtcgtacgtaacggtaaaggttccggggtacccctaggttaccggtaggttacgacggtacggtacgtaggtacggtaacgttacggtacgggtaactaaggttaccgtttaccgtaccgttccgtaccaaacccgtacgtaccggtaccggtaacccgggttccctagggtaccgtaccgtccggttaacggaacgttaccgtttcgacgttaaaccgttaaacgtttaaccgtagttttcggtaaccgtacggttaccgtttacgtacgttccgttttaccgttaccggacccgttccgttaaccgggtttcccggtaaccgggtaacggggtaaaccgtaacgggttaggtaaaccggtaaccgttaaaccccggaaaggttaaccggttacggtaccgggtcctaaccggttaccctacgttaaccccg

SEQ ID NO: 5016 - DNA, 593 bp, Homo sapiens
  misc_feature: GYAE6OF02JOIQK.2.78.H01.1.454.CMB.1.raw
  modified_base (198)..(198): a, c, t, g, unknown or other
  misc_feature (198)..(198): n is a, c, g, or t
  modified_base (312)..(312): a, c, t, g, unknown or other
  misc_feature (312)..(312): n is a, c, g, or t
  modified_base (519)..(519): a, c, t, g, unknown or other
  misc_feature (519)..(519): n is a, c, g, or t
tcagacgctcgacacacgaccggtgctcgatttagtgtgagtagtttgggtttgggggcgaggagtcagaccagtcaggacacagcatggacatgagggtcccgctcagctcctgggctcctgctgctctggttcccaggttccagatgcgacatccagctgacccagctccttctttacgtgtctgcgtctgtgagngacagacttacatcattgtcgggcagtcaggacttattagaccaattagccgtgtatctaggcagaagccctagggcgacgtaccccgtaaactccgtagattcgtactgggtnactatcaagtcttgactaaaggtccggggtaccataccggaggttaccaagaggctaggtggacttcgaggggacctaggacttttacgacgttctacaacctattcgacggccgggtcctaggtcaacggccttaagacgttacgttctacggacaacgttttaccagttcgtaccaggtaatttccagtactttccgtccgagtntcggtttcgcctaaggggcctaaacgggtgaaacgctaccgtaaaggacttcggtgacccttggaccaactcgg

SEQ ID NO: 5017 - DNA, 802 bp, Homo sapiens
  misc_feature: GYAE6OF02IDU4O.2.78.H01.1.454.CMB.1.raw
  modified_base (167)..(167): a, c, t, g, unknown or other
  misc_feature (167)..(167): n is a, c, g, or t
  modified_base (199)..(199): a, c, t, g, unknown or other
  misc_feature (199)..(199): n is a, c, g, or t
tcagacgctcgacacacgaccggtgctcgatttagtgtgagtagtttgggtttggggcaggagtcagacccagtcaggacacagcatggacatgagggtccccgctcagctcctgggctcctgctgctctggttcccaggttccagatgcgacatccagctgacccngtcctccttctttcgtgtctgcgtctgtaganagacagtacttactatctacgttggtcggcgtagtcgaaggtattaagttaacgtaacccaaactttacgtacccgttggttaactccgagacgaaggaaccggtcccgtgggaccgtaaccgtaccccccgttaaaaccgttcccgtaggtacttaccgttagtagggtcaccgtattaccgtaatcgtacgaaaccgtaacggtcggggtaccctaggtaccggtacggttacaaggtacggtacgtaaggtacgtacgtacggtacggaactagttactttacgtaccgttaccgtactaaccgacttcccggaacggtccggtccttacgaccgtacgtaccgtaggtaaacggttaccttcgtaacgtaacctttaacttaacgttactttgaaccggtttaacttacgttaccgttagttaaccgttttcccgttacccggtaccgttaccgtttaacccggggtttaccggacccggggttaaaccgggtaaccgtaaacgggttaaccggtaaagtacccggtttaaaaacccggaaacggtttacggtaaccggttacggtaccccggtaacgttccccgtaaacgtttaacgg

SEQ ID NO: 5018 - DNA, 786 bp, Homo sapiens
  misc_feature: GYAE6OF02IQB26.2.78.H01.1.454.CMB.1.raw
  modified_base (761)..(761): a, c, t, g, unknown or other
  misc_feature (761)..(761): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctcggttcccaggttccagatgcgacatccagctgacccagtcttccttctttcgtgtctgcgttctggtgagtagacagtacttactatcctacgttcgtcgggtcgtacgtcaggtataagttacgtaacctaacgtttacgccgttaggtattcaacggactaacggaaacgtcccgtagggggaccgtaaccggaaccccccctttaaaacgtccccgttagactttccgtaagttcgggtacactacgtagtaaacggttcgtagtaacgtaaacgggggttccgggtaacccctaggttaccggtacggttacgaacgggaaggtccgtaagggtacggtattaccggggaaggtaacctaaggtttacccttttaacgacccgttaccgtaccgaacccttacgtacccgaacgggtcccgtacgttccggactaaccggaccgttaggaaacgttctttaccgtaggaaccctttaaacgttaccttgttacgtaaccggtaattcgggtttactggtttaaccctttcccgttccggacgtgtttaaccgggttccgggaccggtaaacggggtcgtaaacggttcgaaacgtaactaaccggtaaacgtcggtttaacggngacccgttcgaaccctacgttaccg

SEQ ID NO: 5019 - DNA, 697 bp, Homo sapiens
  misc_feature: GYAE6OF02HG6TR.2.78.H01.1.454.CMB.1.raw
  modified_base (184)..(184): a, c, t, g, unknown or other
  misc_feature (184)..(184): n is a, c, g, or t
  modified_base (210)..(210): a, c, t, g, unknown or other
  misc_feature (210)..(210): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtcctccttcttcgngtctgctctgtgagagacagacttanatcacgttggcgggcagtcgaaggtatattacgacctaattacgcctaggtactcagacagaacgccgtgggacgacgtacccctaaactcctagacttcgtagtggtcgactatactaagtctagaacgtaaggtccgggtaccagtacggtaggttacgaggacggtacgaaggttacgaagttccggtacgggaactaggttaactttaccgaaccttccgtaacctaccgtacgtaccgtacggtacccgggtcctacggaccgtacggtacccgtaagaaaccggttactttaccggtacgtaccttaaacgttactattacgtaacgtacgttacgttccttagttaccttttccgttacccggacgttccgttaccgggtttacggaccggtacgggtaaccgtaaaggtacggtaacgtaaccgtaacggtaaaccgttacggtacggttccggaacgttacgtaccgtaccttaacgg

SEQ ID NO: 5020 - DNA, 771 bp, Homo sapiens
  misc_feature: GYAE6OF02JK1H7.2.78.H01.1.454.CMB.1.raw
  modified_base (185)..(185): a, c, t, g, unknown or other
  misc_feature (185)..(185): n is a, c, g, or t
  modified_base (189)..(189): a, c, t, g, unknown or other
  misc_feature (189)..(189): n is a, c, g, or t
  modified_base (359)..(359): a, c, t, g, unknown or other
  misc_feature (359)..(359): n is a, c, g, or t
tcagacgctcgacacacgaccggtgctcgatttagtgtgagtagtttgggtttgggggcagggagtcagacccagtcaggacacagcatggacatgagggtccccgctcagctcctgggctcctgctgctctgttcccaggttccagtatgcgacatccagctgacccagtcttccttcttcgtntcgngtcgtcgtgtggagacgtacagtacttactactcacgttcggacgggcgagtcaggtatagttaacgtaacctacgtaggtcctaggtactacgtagacgaaggtacggccggtgggaccggtaccgaacccccgttaaacgtcccgtagacttccgttagtaccgggtnacctaacgtacgtacgttacgtcgtaaaggtaaccggggttaccggtaccgtacgtaccggtagggttaccgaaggtggtaccgtaggtacggttacgtacggttaggaccgtaaggtttacccttacgaactcccgttacctacctactccgacggtaccgtcgtacggtacgtaccgacgtacgtacgttacgttaccttacgggggttaacctaacgtttacgttaccgtttacgtaaccgttagtcgttacgttacggttacccgtttcccgttccgttaccggtaccgttaccgggttaccgggtaccggtaaccgggtaacggtaacgggttaacggtaagttaaccggtaacccgtaaacggtacggttacggttaccggtcggtacgtacccggaccgttaccg

SEQ ID NO: 5021 - DNA, 805 bp, Homo sapiens
  misc_feature: GYAE6OF02F70MS.2.78.H01.1.454.CMB.1.raw
  modified_base (184)..(184): a, c, t, g, unknown or other
  misc_feature (184)..(184): n is a, c, g, or t
tcagacgctcgacacacgaccggtgctcgatttagtgtgagtagtttgggtttgggggcaggagtcagacccagtcaggacacagcatggacatgaggtcccgctcagctcctggggctcctgctgctctggtcccaggtccagatgcgacatccagctcgacccagtccttccttcgtttcgngtcgtgcgttctgtgagacgactacgtactttaacctatctacgtttacggtcgggacgtagttaccgaaggtattaaacgttacgtaacctaaacgtttacgacccttgggtaacttcaagaccaaggaacgcccgtgggcgacgtaccccgtaactccgtagacttacgtagtcggtacgcgattacgaagttccgtgaaccgtaaaggtccggggtaccccaggttaccggtaacgggttacaggacggtcgtagtacgggattcggtacggactacgttacttttaccgactccgtttaccgaaccgtagtacccgagggtacccgccgttacgaccgtaggtaccccgttaaggaacgttaacttccggtagaaacctaaccttttaagttacggtttcgtaaaccgtagggtttacgtttcgttaacgggttacccttttaccgggtttccccggcggtttaacccggtttaaccggggttttcgggacccgggtaaaccgggggttaacccggtaacggggttaacttaaaccggggaactttaaccggtaaaccgggttaaacctttggggtaacccggttcttaacccggtacccgtaaccgtttaacccgg

SEQ ID NO: 5022 - DNA, 718 bp, Homo sapiens
  misc_feature: GYAE6OF02FQQ6O.2.78.H01.1.454.CMB.1.raw
  modified_base (186)..(186): a, c, t, g, unknown or other
  misc_feature (186)..(186): n is a, c, g, or t
  modified_base (417)..(417): a, c, t, g, unknown or other
  misc_feature (417)..(417): n is a, c, g, or t
tcagacgctcgacacacgaccggtgctcgatttagtgtgagtagtttgggtttgggggcaggagtcagacccagtcaggacacagcatggacatgagggtccccgctcagctcctgggctcctgctgctctggttcccaggttccagatgcgacatccagctcgacccagtctcctttctttcgtnttctgcgttctgtgagacgacagtacttactatctacgttcggtcgggcgagtactaggattacgttaacgtaacctaacgttacgtccgttggtatcagacgaagacgcgtcggaccgaccgtaccccctaactcccgtatacttacgttaggtcgttcgactacgttacgacgttacgtacggaggtaacggttccggtacctacgtacggtacgttacgaggtacggngtaggtaggtacgtagtaggactagttaccttactacctcctacacgtcgtaccgcggtcgtccgacgtaccgagtctaagtacgttcgttacgtacttaaccgttactttacgtttacgtcgtacgttagtttacgtttacttaccggtttctttacccgttccgttaccgggttccgtttaacggggtcccggtaacggggtaaccgggtaacggttaacggtaaccgtaagtaaccggtaaacccgtaaccggttacgttacgggtaccgttacgtaccccgtaccgttaaccgttcg

SEQ ID NO: 5023 - DNA, 971 bp, Homo sapiens
  misc_feature: GYAE6OF02GEYU6.2.78.H01.1.454.CMB.1.raw
tcagacgctcgacacacgaccggtgctcgatttagtgtgagtagtttgggtttgggggcaggagtcagacccagtcaggacacagcatggacatgagggtcccgctcagctcctgggctcctgctgctctggttcccaggttccagatgcgacatccagctgacccagtcctccttcttcgtgtctgcgtctggtgagacgacagacttactatcctacgttggtccgggacgtagtcgaaggtattagttaacgtaccctaaagtttacgccgttacgggtattccgaagcgtaacgaaacggtcccgtcggggaccgaaccggtacccccttaaaaaccgttccccgtaagtacttaccgttaagttcgggtaccgtctaacgttcgtaaacggttccgtaacgggaccgttaaaacggggttcgggggttaacccccagttacggtacggggtttaacccgaagggttaaccgggtacgtaacgggttacgggtaacgttccgggttaacgggggtaaacctaacgggtttaacgtttttacccgaaacccgtttaccggttacccctaacccgtaaaccgtttaccggaaacccgggttacccgggttaccccggttaagggtacccgtaacccggggttaccccgtaaagggttaaaccggttaaccgttttcccgtaaacggttaacccgttaaaaccgttttaaacgtttaaccggttttaccgttaaacggttacggtttacgtttaaccgtttcggttttacccgttttaaccccggtttacccgtacccggggtttaacccttttaccggggtttaccgggtaaccccgggttaacgggggtaacccgttaaaacgggggtaaacggtttacggtaaaacccggttaaaccgtaaaacccgggttaacgggttaccggtttaccggaacccgtacggttaaccccgttaacctttaaccgg

SEQ ID NO: 5024 - DNA, 798 bp, Homo sapiens
  misc_feature: GYAE6OF02GRVS7.2.78.H01.1.454.CMB.1.raw
  modified_base (105)..(105): a, c, t, g, unknown or other
  misc_feature (105)..(105): n is a, c, g, or t
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
  modified_base (302)..(302): a, c, t, g, unknown or other
  misc_feature (302)..(302): n is a, c, g, or t
tcagacgctcgacacacgaccggtgctcgatttagtgtgagtagtttgggtttgggggcaggagtcagacccagtcaggacacagcatggacatgagggtccccnctcagctcctggggctctgctgctctggttcccaggttccagatgacgacatccagctagacccagttcctctttntttcgngtctgcgtctgtagagaacgacagtactttataactccaacgtttggtccgggcgtaacgtcgaggaattaacgttaacgtaacctaacgtttacgccgttaggtacttacgaanccgaaggtaaacgtcccggtggggaccgacgaccccttaaaccgtaccctagacttctagttgggactacgactcaaaggttctaagggactaaaacggggttccgggtacctaacggtttacggttaaggttaggggtacgtaggacggtttaggacggttacggtacgggtaaactacgggttaaactttccgtaaccgtttcccttaaccgacccgtaaacgtccgtacggacccgggttcccgtaggacccgtacggtaccttaacgggaaattacgtttacgaccgtaaacctttaacgtttaacttaacggttttacgtctaacgggtttacttccgttttacgtttaccgtttaccccgtttcgtacccgttacggttaaccggtttccgggaccggtacgggtaacggttaacgggtaaggaacggttaacgtaacgaaaaccgttacggttacgtacgggtacgtaccgtacgtaccgtattaccgg

SEQ ID NO: 5025 - DNA, 615 bp, Homo sapiens
  misc_feature: GYAE6OF02IQRUD.2.78.H01.1.454.CMB.1.raw
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (409)..(409): a, c, t, g, unknown or other
  misc_feature (409)..(409): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagaccttactatcacttgtcgggcgagtcaggatattagtaccaattagcctggtatcagctagaagcctgggcgagcccctaaactcctgatctatggtcgctatcagtctgacaagtgggtcccatcgagttcagaggcagtggatcgnggganagactttcactcctcgacctagtcagccggcctgctagctgaacgattcngcctaacttactatttcggtactaggtacgtttcttacggtactttaccgtttccccgtacgtcccgtaacggttttccgggtacccggtaaccgggggtaacccgttaaacggggtaccggtaacgggtaaacgtcccgtaaaaccgggttaaaccttaccggggttacggtacccggttaacggtccccgtaacccgttaccgg

SEQ ID NO: 5026 - DNA, 821 bp, Homo sapiens
  misc_feature: GYAE6OF02GGU79.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctgggctcctgctgctctggttcccaggttccagatgcgacatccagctgacccagtcctccttctttcgtgtctgcgtctgtagagagacagtacttactatctacgttgcgggcagtcgaggtattattaacgtacctaacgttagccgtggtactcaggcaagaacgccgtagggccgaaccgtaccccctaaaactccgtagtacgtaggttacgtggtacgtactaacgtacgtaaagttcgtagtaaccgtaaaacgggtcggggttaccccaagttccggtaaggttaccgaaggacggtacgtagggtacggtaagttcggtaacgggaactacggttaacttttacccgaacccgttacctacccgtaaacgtacgtaaccggtacgggtacccggtacccgtcggtaccgtaaccggtaacccgttaagggtaaacgttaccgtttccggttaacgtaaccctttaaacgtttaaccgttagtttaccgtaacgttaaacgggttcctttacggttactttaccgtttttaccccgttccccgttaacggtcccgttttaaccgggtttccgggaacccgggttaaacgggggtaaaccccggttaaaggggttaacccggtaaacggtaaaccggtaaccggtaaaacggtttacggtacggttaccggacgtttacgtaacccggtacctttaacg

SEQ ID NO: 5027 - DNA, 567 bp, Homo sapiens
  misc_feature: GYAE6OF02G8GXY.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtcctccttctttcgtgtctgcgtctgtgagagacagacttactatcacttgtcggcgagtcaggatattagaccaacttagcctgtatcagcagaagcctgggcgagcccctaaactcctgactctatcggtgcatcgaagtctgtcgaaaagttggggtccctagtcgaggttcaggaggcaggtggatcgagggtacagtactttcactctccactatcaagcggcctgcacgcctagaagtacttcgtcgacctaacttactatttcgtacacgtagtttcgtgtaactttccgtttccggaccgtcgtaccggtttcggcccgtagggggtaccctaagggtacgaaggtacgtacgaaacgtaacgttcggtaggtccgtgtaccactaccg

SEQ ID NO: 5028 - DNA, 766 bp, Homo sapiens
  misc_feature: GYAE6OF02J1QWN.2.78.H01.1.454.CMB.1.raw
  modified_base (402)..(402): a, c, t, g, unknown or other
  misc_feature (402)..(402): n is a, c, g, or t
  modified_base (588)..(588): a, c, t, g, unknown or other
  misc_feature (588)..(588): n is a, c, g, or t
tcagacgctcgacacacgaccggtgctcgatttagtgtgagtagtttgggtttgggggcgaggagtcagacccagtcaggacacagcatggacatgagggtcccgctcagctcctgggctcctgctgctctggttcccaggttccagactgcgacactccagtctcgacccagtccttcccttctttcgtgtctcgcgttctgtcgagagactacgtacttacacttccaacgtttggccgggcgtacgttacgaaggttatttacgtaaccgtaaccttaacttacgtaccgttaaggtattacgacggacgtaagaacgcccttaggggccgtaaccgaccccttaaaccgtcctacgacttcgtaacgttggtacgtactactacgtaaggtccgttanaaaccggtaaggggttccggtaacctacgtacggttaacgttaacggagggtaacggcgtaggttaccgtaggtacgttaggggaaccttaaaggtcttaaccgtcgtttaccgaccctaccgtaacgtaaccgacggtacggacccttagcccgtaaggtcccgtaaaggtaacttaaccggttnttacgaccgttaaacttcgtaacgttcgaacgttactcggttttcaacgttaccgttacccttccgggtactaccgtttaccgtcggtaccgtaacgggtaacgaaaccggttaggaacgtaacgtaacgttaaacggacgttaccgtaacgttccggaacttaccggacccttacgg

SEQ ID NO: 5029 - DNA, 660 bp, Homo sapiens
  misc_feature: GYAE6OF02FI6SV.2.78.H01.1.454.CMB.1.raw
  modified_base (207)..(207): a, c, t, g, unknown or other
  misc_feature (207)..(207): n is a, c, g, or t
  modified_base (331)..(331): a, c, t, g, unknown or other
  misc_feature (331)..(331): n is a, c, g, or t
  modified_base (357)..(357): a, c, t, g, unknown or other
  misc_feature (357)..(357): n is a, c, g, or t
tcagacgctcgacacacgaccggtgctcgatttagtgtgagtagtttgggtttgggggcaggagtcagacccagtcaggacacagcatggacatgagggtccccgctcagctcctgggctcctgctgctctggttcccaggttccagatgcgacatccagctgacccctagtcctccttctttcgtgtctgcgttctgtgagagacngtaccttacatcacgtttggcgggcagtcaggattagttacgtaacctaacgttagtccctaggtatcgtagcagaacgtccgtcggggccgacgacccctaaactccgtagtatctagtggtncatcagtctgcgaaaggtcggtccancggtagtcagacggcagtgtatcgtaggactagtacttcgacctcgtactacgactcgacggccggtcctggaccacggtccttagaacggttacttccgtacgtaccgttaaactttacctttagttacgacgtaaggttacgttttactcggtttacctttcccgttaccccgagttaccgttaccgggttttacggacgggtaacccgggtaaccggtaaagggtaacgaacggtttaacgaaccggaaaaccggttacggttaccggtcgggttacctcgggtaacccacccgtttacg

SEQ ID NO: 5030 - DNA, 759 bp, Homo sapiens
  misc_feature: GYAE6OF02IXZXS.2.78.H01.1.454.CMB.1.raw
  modified_base (280)..(280): a, c, t, g, unknown or other
  misc_feature (280)..(280): n is a, c, g, or t
tcagacgctcgacacacgaccggtgctcgatttagtgtgagtagtttgggtttgggggcaggagtcagacccagtcaggacacagcatggacatgagggtccccgctcagctcctgggggctcctgctgctctggttccccaggttcccagactgcgacactccgaggctcgacccagttcctcctttcgtttcgtgtctgccgtctgtgagacgactagtacttactatctacgttggtcggcagtacaggtatacttagacctaactagcctaggtcncagtacaagacgccgtagggaccaacgacccctaactaccgtagacttctaacggtggtaccactatacgtaacggtccttagaacgtaaacgggtcggggtaccccaggttacgtaacccgggttacaaggacggtactacgggtagtacggtacgttaggggaactaggtacttacctacgtcgacctaacacgtcgaacggcgtacgtgacgtctacccgtagaaccgttattactaccggttaacttaaccgttttaccgtagtttaccgtacggttaagttacgtttaccgttaacggtttccctttaacccgtttcccaaaccggtttcccgggttaaattttaccccgggggacgttaaaggggacccgttaaacggggttaaggaaacccttaaggttaaaacccggaaacccggttaaccggttaggtttaccccgggtacgtaacccgttacccgtaaaccgttaacgg

SEQ ID NO: 5031 - DNA, 800 bp, Homo sapiens
  misc_feature: GYAE6OF02F06IT.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctgacccagtcctccttctttcgtgtctgcgttctgtgagagacagtacttactatcacttggtcgggcagtcaggatattagaccacttagcctgtatcagcagagcgtgggcgacgcccctaaactcctgatctagtcggtgcatcaagtctaggactaaaggttcgggtacccctagtcggtaggttaccgaggtacggctaaggtggtaacgttcggtacgggaacctaaggttattttaccgaacgttcctaccctaacccagttaccgaacgggtccggtacccgttagggacccacggttacccgtaaggtaaacggttacttttcgtaaacccggtacctttaaacccttttaaccgtttaagttttccggtaaccgttagggtttaaaccgggttttttccgttaccggttttaaccgttttttcccccgttttaacccgggtacccggtttaaccggtttacccgggttttaccggggtacccgggttaaaacggggggggtaacccgttaaaacggggttaaaccgggttaacggtaaaccgtttaaaccgggtaaaccccggttaaacggtttccgggggtttaaccggtacccttacggggtaacccctaaacccgtttaacccgg

SEQ ID NO: 5032 - DNA, 935 bp, Homo sapiens
  misc_feature: GYAE6OF02JOOPX.2.78.H01.1.454.CMB.1.raw
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctcgaccccagtcctccttctttcgtgtcctgcgtctgtgagagacagtacttactatcacgtttggcgggacgtagtcgaggtacttaattacggttaaccctaaacgttacggtccgttaggttaactccgtaagccgaaaggtaaccggtccggttacggggaccggtaacccgtaaccccccgttaaaacgtcccgtacgtacttaccgttaacggtgggttacaccgtacgttaccgtaaacggttccgtaagacccggtaaaacggggtttccgggggtacccctacggttaccggtaacggggtttaccgaagggtaccgggtacgtacgggtacggtaacttccggggtaacggggtaaaccctaaggtttaaccttttccctaaccgtcccttaacccgaaacctacggtacccggtaacgggtccggtacccgtacggtacccgaaccgggttaccggtaaaggaaccgttttaacggtttaccgtaacggttaaaccccgtttaaacgttttaccgtttaaccgggtttacgtacgggtttaaaccgttcgttttacccgtttaagttttacccgtttttcccccgggtttacccgtaacggtttcccgggtttaaacgggttttacccgggggaacccgggttaaccgggggttaaccggtaaaacggggttaccgggttaaacgttaaaccccgtacggttaaaaacccggtggttccgggtacccgggttaccctacgggtaccccttaccgggtttaac

SEQ ID NO: 5033 - DNA, 740 bp, Homo sapiens
  misc_feature: GYAE6OF02F8YRA.2.78.H01.1.454.CMB.1.raw
  modified_base (193)..(193): a, c, t, g, unknown or other
  misc_feature (193)..(193): n is a, c, g, or t
  modified_base (365)..(365): a, c, t, g, unknown or other
  misc_feature (365)..(365): n is a, c, g, or t
  modified_base (530)..(530): a, c, t, g, unknown or other
  misc_feature (530)..(530): n is a, c, g, or t
tcagacgctcgacacacgaccggtgctcgatttagtgtgagtagtttgggtttgggggcaggagtcagacccagtcaggacacagcatggacatgagggtccccgctcagctcctgggctcctgctgctctcggtcccaggttccagatgcgactactccagtctcgaccctagtccttcctttcgtttcgtntctgtcgtctgtagagacgacagtacttactatctacgttggtaccgggactagtacgaaggtattaagttaactaacctaaacgttacgtaccgtagtatacgagtacgaagtaacggccgtagggaccgaaccgtaacccctaactccgtagtaacttcgtacgtcggtntacctaagtacgtaaaggtcctaacggtaacgtaaacgggttccgggtaacccctaggtacggtaacgtacgaacgggtacgtacgtaggtacggtacttacgtaggaactaagttacgttacacttacgtaccaccgtacgtacgacggtccgcgtaggtaccncgtacgtaacgtagtaccgttagtacctaacgttaaactttacgtagttaacgtacgtaaggttaccgttcgttacgtttacccgttccggttacccacggttaacgttaccgggttaccggaaccggtacgggtaaaccggttaaggtaccgtaagtaaccgtaacggtaaacgtggtacgttaccgggacttaccgacttaccgtacg

SEQ ID NO: 5034 - DNA, 793 bp, Homo sapiens
  misc_feature: GYAE6OF02F6SIF.2.78.H01.1.454.CMB.1.raw
  modified_base (185)..(185): a, c, t, g, unknown or other
  misc_feature (185)..(185): n is a, c, g, or t
tcagacgctcgacacacgaccggtgctcgatttagtgtgagtagtttgggtttgggggcaggagtcagacccagtcaggacacagcatggacatgagggtccccgctcagctcctggggctcctgctgctctggttcccaggttccagatgcgacatccagctcgacccagtctccttctttcgngtctgctctgtgagagacagtaccttaactatctacgttgtcggggcagtcaggtatattaacgtaccaacttagcctaggtatccagcagaacgcccgtagggacgaccgtaccccttaaactcccgtagaacttacgtacgtggttacgactaacgtaccaaagttcgttacgaaccggttaaaacggggttccgggggtaacccccttaaaggtacccgggtttaaggtaccgtaacgggaacgggtacgtaagggtttacggaagtttcggtaacggggtaaataaccgggttaaacttttaccctaaccgttccttaacccgaaccgtacgtttaccggaaacggtccgggtacctccggacgtaaccggtaccctaaggtaaacgtacgtttcgtaacgtaccgtaaactttacgttacgtttacgttaacgagtttacgtttaacgttacgttaacgttttcccgttacccggtacggttaccgtttaccgggtttaccggtacccgggtaacgggtaacccggtaagggtaacggttaacgtaaccgttaacgtaaaaccgacgttacgggagttacccggtaacggtaccaccttaccg

SEQ ID NO: 5035 - DNA, 242 bp, Homo sapiens
  misc_feature: GYAE6OF01C9TGN.8.28.C06.1.454.CMB.1.raw
  modified_base (240)..(242): a, c, t, g, unknown or other
  misc_feature (240)..(242): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgagcgggctggcaaggcgcatagnnn

SEQ ID NO: 5036 - DNA, 512 bp, Homo sapiens
  misc_feature: GYAE6OF01DJ3WV.8.28.C06.1.454.CMB.1.raw
  modified_base (309)..(309): a, c, t, g, unknown or other
  misc_feature (309)..(309): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
  modified_base (510)..(510): a, c, t, g, unknown or other
  misc_feature (510)..(510): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccagtggaatcccagccaggttcagcggcagtgggtctgggacttcgttcactctcaccatcaataacctgcaatctgacgactttgctagtttattctgtcagtcagtctgaagactggccgtttcacgtttcggcggtagggaccaagggtcgacctcaaacgactgtgctgcacntctntcttcatccttccgcntc

SEQ ID NO: 5037 - DNA, 510 bp, Homo sapiens
  misc_feature: GYAE6OF01EOSB3.8.28.C06.1.454.CMB.1.raw
  modified_base (508)..(508): a, c, t, g, unknown or other
  misc_feature (508)..(508): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagctttaggacgaacttagcctggtatcagcagaggcctggccaggctcccagactcctcatctttggcgcctttaacagggccagtggaatcccagccaggttcagcggcagtgggtctgggacttcgttcactctcaccatcaataaccctgcaatctgacgactttgcagtttatttctgtcagcagtctgaagactggccgttcactttcggcggtagggaccaaggtggacctcaaacgactgtggctgcacatctgtcttcatcttcccgcntc

SEQ ID NO: 5038 - DNA, 511 bp, Homo sapiens
  misc_feature: GYAE6OF01DO774.8.28.C06.1.454.CMB.1.raw
  modified_base (209)..(209): a, c, t, g, unknown or other
  misc_feature (209)..(209): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (502)..(502): a, c, t, g, unknown or other
  misc_feature (502)..(502): n is a, c, g, or t
  modified_base (508)..(508): a, c, t, g, unknown or other
  misc_feature (508)..(508): n is a, c, g, or t
tcagctcgcgtgtccacgaccggtgctcgatttagagctcacgtattgggtttgggggaggaactgctcagttaggacccagacggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatcctggtaccaacagaaacctggccaggctccaggcccctnatctatggtgcatccaaacngggccactggcatcccagccaggttcagtggcagtgggtatgggacngtacttnactctcaccatcatcagcctggagcctgaggatgttgcagtttatactgtcaacatcgtacgagtggcctccggggccacgtttcggcccgtggaccaaagtggatatacgaaacgaactgtggctgcacatntgtctntac

SEQ ID NO: 5039 - DNA, 505 bp, Homo sapiens
  misc_feature: GYAE6OF01DWV6A.8.28.C06.1.454.CMB.1.raw
  modified_base (438)..(438): a, c, t, g, unknown or other
  misc_feature (438)..(438): n is a, c, g, or t
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactgccgttnactttcggcggagggaccaaggtgacctcaaacgactgtgctgcacntctgtcttcatctccgcntc

SEQ ID NO: 5040 - DNA, 567 bp, Homo sapiens
  misc_feature: GYAE6OF01DZI30.8.28.C06.1.454.CMB.1.raw
  modified_base (212)..(212): a, c, t, g, unknown or other
  misc_feature (212)..(212): n is a, c, g, or t
  modified_base (333)..(333): a, c, t, g, unknown or other
  misc_feature (333)..(333): n is a, c, g, or t
  modified_base (538)..(538): a, c, t, g, unknown or other
  misc_feature (538)..(538): n is a, c, g, or t
tcagctcgcgtgtccacgaccggtgctcgatttagagctcacgtattggggtttggggggaggtaactgctcagttaggacccagaccggaaccatggaaagaccccagcgacagccttctcttcctccctcgctactctgggctcccagacgatcagttggagaacgtgggtgatgacacagtctccggtcaccctggtctggtttttccnggggatagagccaccctctccctgtcgcggccagtcagagcgttaggacgaacttagcctggtatcagcagaggctggccaggctcccagactcctcagtcgtttcggcgtcctttaacgngggtccagtggaatcccaagccgaggttcagtcggacacgtcgggtctagggacttcggtcactctcacctatacaataaccctgacaatacctgtaaccgtactttagacttagtttactttctgtcagcacgtctagaacgtctggtccttcacgtttcggcggaggaccaaggtcgactacgaacgactcgtgctcgacacnctctgtcttctatccttcccgctacgtcg

SEQ ID NO: 5041 - DNA, 895 bp, Homo sapiens
  misc_feature: GYAE6OF01CVCKN.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcaccctgtctgtttttccngggganagagccaccctctcctgtgcggccagtctagagcgttaggacgaacttagcctggtatcagcagaggcctggccaggcctcccagacctcctcattcgtttggccgtaccttttaacgacgggccaaggttcgggaaacttcccccgaaggccccgtaaggggtttccaacgggccgggaccgtaagggttcgggggttaccgttcggggggtaacccttttccgggtttacccaaccttccgttacccaaacccctaaacgtttaaccctaaaaacgtttaaaccccgttagggaaccctaaaacgttccgttacgggtaaacccgggttaaccttttttcgggacccgtttaaacggtttttttaacttttccgtttacggttaccgtaacggttccgtaaacgggtttaccttaacgggtaaaacggttaccggttaccgggggttaccccgttttacccgttaaacccgggtttttccgggggaacccgggggtaaacgggggtaaaccccggtaaagggggttacccggggtaaaccccttaaccggtaaaaaaccgggtaacccggttacgggttaccggggtacccgtttacgggaacccctaaacccgtacgtttccccggtttcggtttacccttttacccaaccgttttccccgtttaccccccggacccttaacgttacccgg

SEQ ID NO: 5042 - DNA, 698 bp, Homo sapiens
  misc_feature: GYAE6OF01BMWER.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccaggagatctagtggagaagtggtgatgacacagtccgtccggtccacccgtgttctttcgtttttccgtggggagagacgcccaccctctcctgtcgccggccagtcaggacggtcggttaacggaacgtaacgttacgccgttaggtactcgagcgaaggacggtccgtcgggacccgacgggtccctacccgaagtacccttcctactactttcgtttcgggcccgttacctttaacggacgggacctaggtacggaacctcccgacgaccggtaggttacgacggccggacgtaggtcgggtcgtgggtacctttcggtctactctaccacctactactaaactaaccgtgactaatcgtacgtacgttacgtttcgacttagttttactttcgtcgttacagtcgtacgttcgtagaacgtacgtccggtccgttacgtaccggtttcgggacgggtaacgggacgtaacgggtcgacctaacgaaacgtacgtggtacggcgtcgaccacgtctacgttcgttccttactaccttcccgtccccgtctacgttccg

SEQ ID NO: 5043 - DNA, 547 bp, Homo sapiens
  misc_feature: GYAE6OF01BELVD.8.28.C06.1.454.CMB.1.raw
  modified_base (194)..(194): a, c, t, g, unknown or other
  misc_feature (194)..(194): n is a, c, g, or t
  modified_base (309)..(309): a, c, t, g, unknown or other
  misc_feature (309)..(309): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagagccaccctctcctgtgcggccagtcagagcgttaggacgaacttagcctggtatcagcagaggcctggccaggctcccagactcctcatctttggctcctttaacngggccagtggaatcccagccaggtcagcggcaggtggtctgggacttcgtcactctcacatcaatacctgacaatctgacgtactttgactagtttatttctgtcagctagtctagaacgtactggtccgttcgtacgtttcgggacgggtacgggtaccgtaagggtacggacctacgaaacggtacttggtaggcctggaccaccgtatctgtccttcacttcctcccgctatccg

SEQ ID NO: 5044 - DNA, 550 bp, Homo sapiens
  misc_feature: GYAE6OF01A0IU7.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttgggacgaacttagcctggtatcagcagaggcctggccaggctcccagactcctcatctttggcgcctttaacagggccagtggaactcccagccaggttcagcggcagtgggtctgggacttcgtcactctcaccatcaataccctgcaatctgacgtactttgctagtttatttctgtcagcagtctagaagtactcgggtcccgtttcaccgtttccgggcgggtacgggaccgtaagggtcggaccctacgaaacgtaacgtgtcggctcgaccaccatcctgtcttcattcccttcccgtcctactccg

SEQ ID NO: 5045 - DNA, 564 bp, Homo sapiens
  misc_feature: GYAE6OF01BO4MV.8.28.C06.1.454.CMB.1.raw
  modified_base (200)..(200): a, c, t, g, unknown or other
  misc_feature (200)..(200): n is a, c, g, or t
  modified_base (351)..(351): a, c, t, g, unknown or other
  misc_feature (351)..(351): n is a, c, g, or t
  modified_base (421)..(421): a, c, t, g, unknown or other
  misc_feature (421)..(421): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctgggganagagccaccctctcctgtgcggccagtcagagcgttaggacgaacttagcctggtatcagcagaggcctggccaggcctcccagacctcctcattctttgggcctcctttaacgacggggccaggtggaactcccagcctaggtcagcggnaggtgggtctgggacttcgtcactctcacatcaaatacctgacaatctagactactttgacttagttttnttactgtcagtctagtctaggaacgtcgtcgggtccttcgtacgtttccggggacgggtaacgggaccgtaagggtccgacctacgaaacggtactggtacggctcgcactactctcgttccttcacttcctcccgctatccg

SEQ ID NO: 5046 - DNA, 515 bp, Homo sapiens
  misc_feature: GYAE6OF01AC4V4.8.28.C06.1.454.CMB.1.raw
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (495)..(495): a, c, t, g, unknown or other
  misc_feature (495)..(495): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcncctttaacngggccagtggaatcccagccaggttcagcggcaggtgggtctgggacttcgttcactctcaccatcaataacctgacaatctgacgtactttgctagtttattctgtcagcagtctgaagctggtccttcacgtttcggacggtagggaccagggtcgacctacgaaacgtactgtggctgcacntctgtctcatctccncntcg

SEQ ID NO: 5047 - DNA, 865 bp, Homo sapiens
  misc_feature: GYAE6OF01BXFKA.8.28.C06.1.454.CMB.1.raw
tcagctcgcgtgtccacgaccggtgctcgatttagagctcacgtattgggtttggggggacggaacgtgcgttccagtttaaggacccagaccggaaccccatggaagccccaagtcgcagcttcctcttcctcctagtcctacgtcctggcctcccgagagactccaagttgggacgtaacgtagggtagaattggtacctacgtacgttcccttcccggttccaaccccttgttcccttggtttttccccgtgggggtaggaccgtaccgcctacccggttctcccttggtcgccggaacctagtccagtagccgttaaggaccgaacgttacggccctagggtactcgagacgacgtacggccctaggcccctaggcctaccccacgacccttccgtaccaacttccgttttcgggacccgggtacccttttaaacgacggggtaccccttaaggtaccgggaaaccttacccccgtaaggtacccccgttaaggggtttacctagggaccggtaccgtaagggttccggggttaccgttcccgggggtaacctttcggttaccgacctttcgtaccgtacccgagttaccggaaacttacctgtacctaactcgtacgaacgtactttgtacttagtttattacttagtctagtctagttctagtaacgtacgtacgggtccgttaacgtaccggtttaccgggacgggtaacgggtaacccgtaacgggtacggtaaccccgtaacgtaaaaccggtaacgttcggtacggtacccgttaccgtaccgtaacccgtacgtttccgtaccgtttacctttaccgtacgttaccccgttacccccgtcccgtacgtacccgg

SEQ ID NO: 5048 - DNA, 610 bp, Homo sapiens
  misc_feature: GYAE6OF01C60IO.8.28.C06.1.454.CMB.1.raw
  modified_base (143)..(143): a, c, t, g, unknown or other
  misc_feature (143)..(143): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (425)..(425): a, c, t, g, unknown or other
  misc_feature (425)..(425): n is a, c, g, or t
  modified_base (585)..(585): a, c, t, g, unknown or other
  misc_feature (585)..(585): n is a, c, g, or t
tcagctcgcgtgtccacgaccggtgctcgatttagagctcacgtattggggtttgggggaggaactgctcagttaggacccagacggaaccatggaagccccagcgcgacgcttctcttcctcctggctactctgctcccagngatcgattggagaagtggttgatgaccacacgtctccggtccaccctgtctgttttccnggggangtaggccaccctctccgtgtcgcggcccagttccaggagcgttaggacgaacttagcctggtatacaggcagagcctaggccgaggcctccagactcctctatctttggcgtacctttaacgagggtccctaggtcggaactccccgagtcccgtacggttcaggcggctaggtgggtctgggtactttcgtcgacgtctacacctatcaatacccngactaactcctagaccgtactttacgctagtttacttctagttactagtctagtactaagtaacgtctccggtccgttactaccgtttcgggaccggtacgggtaccgaagggtcggacctacgaaaccgtacgtcggtggcgtcgacctacctatcgtntcttcacttccttcccgcctctccg

SEQ ID NO: 5049 - DNA, 556 bp, Homo sapiens
  misc_feature: GYAE6OF01BD7O8.8.28.C06.1.454.CMB.1.raw
  modified_base (315)..(315): a, c, t, g, unknown or other
  misc_feature (315)..(315): n is a, c, g, or t
  modified_base (524)..(524): a, c, t, g, unknown or other
  misc_feature (524)..(524): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcattctttggccgtcctttaacgnggggccaggtggaactcccagccaggttcagcggcaggtgggtctgggacttcgtcactctcaccatcaataacctgacaatctgacgtactttgctagtttattctgtcagctagtctagaacgtactcggtccgtttcacggtttcggcgggtagggacccgaagggtcggaacctacgaaacgacgtggtcggcgtcgccaccgtntcctgttcttctacttcccttcccgcctgtcg

SEQ ID NO: 5050 - DNA, 509 bp, Homo sapiens
  misc_feature: GYAE6OF01A19SE.8.28.C06.1.454.CMB.1.raw
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagccaccctctcctgtgcggccagtcagagcgttaggacgaacttagcctggtatcagcagaggcctggccaggctcccagactcctcatctttggcgtcctttaacagggccagtggaatcccagccaggttcagcgcagtggtctgggacttcgtcactctcaccatcaatacctgcaatctgacgactttgctagtttattctgtcagcagtctgaagactggccgttcacgtttcggcggagggaccaaggtggacctcgaacgactgtggctgcacntctgtcttcattcctcccncntc

SEQ ID NO: 5051 - DNA, 577 bp, Homo sapiens
  misc_feature: GYAE6OF01DIS09.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcattcgtttggccgtacctttaaacgaggggccaggtcggaactccccaagcccaggttcagcggcaggtggggtctgggacttcgttcactctcaccatacaaactacctgacaatctagactatttgacttagttttattctgtcaggctagtctagaagcgttgggccttcgtaccgtttcgggacgggtacgggaacctaagggtcgacctacgaaacggtactggtacggctcgaccacctattcgttgtcctttcactttcccttccccgctacgtccg

SEQ ID NO: 5052 - DNA, 572 bp, Homo sapiens
  misc_feature: GYAE6OF01BWFUJ.8.28.C06.1.454.CMB.1.raw
  modified_base (195)..(195): a, c, t, g, unknown or other
  misc_feature (195)..(195): n is a, c, g, or t
  modified_base (538)..(538): a, c, t, g, unknown or other
  misc_feature (538)..(538): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtcgcggccagtcagagcgttaggacgaacttagcctggtatcagcagaggcctggccaggctcccagactcctcatctttggccgtacctttaacgcggggccaggtcggaactcccagcctaggttcagcggcaggtgggtcgtgggacttcgtcacgtctcaccatacaaatacctgacaatctagacgtactttgactagtttactttctgtcagctagtctagaacgtcgtggtccgttctaacgtttcgggacgggtaacgggaccgtaaagggtcggaacctacgaaacgtacgtggtcgcgtcgacctacgtnttctgttcttacacttacccttcccgctcgtacg

SEQ ID NO: 5053 - DNA, 545 bp, Homo sapiens
  misc_feature: GYAE6OF01DOTHC.8.28.C06.1.454.CMB.1.raw
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccggcgcagcttctcttcctcctgctactctggctcccagagatcgttggagaagtggtgatgacacagtctccggtcaccctgtctgtttttcctgggggagagagccaccctctcctgtgcggccagtcagagcgttaggacgaacttagcctggtatcagcagaggcctggccaggctcccagactcctcatctttggcgcctttaacngggccagtggaatcccagccaggttcagcggcagtggtctgggacttcgttcactctcacctatcaaataacctgcaatctagacgtactttgctagtttatttctgtcagcagtctagaagtactggtccgtttcacgtttccggcgggtaacgggacctaagggtcggacctacgaacgtaacgtgtcggctgcaccatctgtcttcacttccttcccgctactcgtgaacg

SEQ ID NO: 5054 - DNA, 686 bp, Homo sapiens
  misc_feature: GYAE6OF01BTINI.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
  modified_base (367)..(367): a, c, t, g, unknown or other
  misc_feature (367)..(367): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgtttttccngggganagagccacctctcctgtgcggcagtcagagcgttaggacgaacttagcctggtatcagcagagcctggccaggctccagacctctnatcttggctctttaagngggccagtggaactcccagcctaggtcagcggcaggtggtctgggacttcgtcactctacacntcaaatacctgactaatctagaccgtatttgactagtttacttctgtacagtctagtctagacccgggggtttttaaacccggttacccggggtttaacccggtttaacccggtttaaccgggtttacccgggtaaccgggttaaccgggtaacccggttaacgggtttacccgggtaacccgttaaccggtaaaccggttaaccggttaccggttaccgggttaaccgttaccggtaccgtaacccgttacgttaccggttacggttaccgttaccggtaccgttacccgttacccggtaccgttaccggttacccgg

SEQ ID NO: 5055 - DNA, 512 bp, Homo sapiens
  misc_feature: GYAE6OF01BDOY5.8.28.C06.1.454.CMB.1.raw
  modified_base (508)..(508): a, c, t, g, unknown or other
  misc_feature (508)..(508): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggtccaggtggaactccccagccaggttcagcggcagtgggtctgggacttcgtcactctcaccatcaaatacctgcaatctgacactttgctagtttattctgtcagcagtctgaagctggccgttcacgtttcggcggtagggaccaaggtcgacctacaaacgaactgtggctgcacatctgtctcatctccncatc

SEQ ID NO: 5056 - DNA, 530 bp, Homo sapiens
  misc_feature: GYAE6OF01ATHBD.8.28.C06.1.454.CMB.1.raw
  modified_base (301)..(301): a, c, t, g, unknown or other
  misc_feature (301)..(301): n is a, c, g, or t
  modified_base (486)..(486): a, c, t, g, unknown or other
  misc_feature (486)..(486): n is a, c, g, or t
  modified_base (498)..(498): a, c, t, g, unknown or other
  misc_feature (498)..(498): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcncctttaacagggccagtggaatcccagccaggttcagcggcagtgggtctgggacttcgtcactctcaccatcaatacctgacaatctagacgtctttgctagtttacttctgtcagtcagtctgagactggtccttcacgtttcggcggtagggaccaaggtcggacctcgaaacgtacgtagnggctgcaccgtntctgtcttctacttcccttcccgcctagtccg

SEQ ID NO: 5057 - DNA, 532 bp, Homo sapiens
  misc_feature: GYAE6OF01C9B73.8.28.C06.1.454.CMB.1.raw
  modified_base (310)..(310): a, c, t, g, unknown or other
  misc_feature (310)..(310): n is a, c, g, or t
  modified_base (504)..(504): a, c, t, g, unknown or other
  misc_feature (504)..(504): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccagtggaatcccagccaggtcagcggcagtgggtctgggacttcgtcactctcaccatcaataacctgcaatctgacgtactttgctagtttatttctgtcagcagtctgaagactggtccgttcacgtttcgggaccgggtagggaccgtaagggtcggacctacgaaacgacgtggtggcgtcgcacntctgtcttcactccttcccgctacgtcg

SEQ ID NO: 5058 - DNA, 606 bp, Homo sapiens
  misc_feature: GYAE6OF01C5L89.8.28.C06.1.454.CMB.1.raw
  modified_base (197)..(197): a, c, t, g, unknown or other
  misc_feature (197)..(197): n is a, c, g, or t
  modified_base (314)..(314): a, c, t, g, unknown or other
  misc_feature (314)..(314): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagccaccctctcctgtgcggccagtcagagcgttaggacgaacttagcctggtatcagcagaggcctggccaggcctccagactcctcatctttggccgtcctttaacngggccagtggaactcccagccaggttcagcggcaggtggtctggggacttcggtcactctacaaccagtcacgcagcctagagcctagaagtatttgacttaagtttattactgtactaacactacgtaccggagtcgggcccgtccgggggacctaccgtttccgggacccgtacgggaaacctaaaacgttagaagtaactacgaaaacggtaaccgtaggtggtcgtaggaccaccgtacttaccgttcgttccgtttacctaccttcccgtttccccgccttaacccg

SEQ ID NO: 5059 - DNA, 524 bp, Homo sapiens
  misc_feature: GYAE6OF01BU42F.8.28.C06.1.454.CMB.1.raw
  modified_base (522)..(522): a, c, t, g, unknown or other
  misc_feature (522)..(522): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatccccagccaggttcagcggcagtgggtctggggacttcgtcactctcaccatcaataacctgacaatctgacgtactttgctagtttatttctgtcagcagtctgaagactggccgttcacgtttcgggcggtagggacctaagggtcggacctacgaaacgaactgtggctgcaccatctgtcttcatcctcccgctntc

SEQ ID NO: 5060 - DNA, 518 bp, Homo sapiens
  misc_feature: GYAE6OF01CJVRE.8.28.C06.1.454.CMB.1.raw
  modified_base (497)..(497): a, c, t, g, unknown or other
  misc_feature (497)..(497): n is a, c, g, or t
  modified_base (514)..(515): a, c, t, g, unknown or other
  misc_feature (514)..(515): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcacatcaataacctgcaatctgacgtactttgctagttttattctgttcagtcagtctgaagacttggccgtttcaccttttcgggacggtagggaccaaggtggacctcgaaacgactgtggctgcacntctgtcttcatctcccnntcg

SEQ ID NO: 5061 - DNA, 536 bp, Homo sapiens
  misc_feature: GYAE6OF01CSJW1.8.28.C06.1.454.CMB.1.raw
  modified_base (287)..(287): a, c, t, g, unknown or other
  misc_feature (287)..(287): n is a, c, g, or t
  modified_base (388)..(388): a, c, t, g, unknown or other
  misc_feature (388)..(388): n is a, c, g, or t
  modified_base (494)..(494): a, c, t, g, unknown or other
  misc_feature (494)..(494): n is a, c, g, or t
  modified_base (530)..(530): a, c, t, g, unknown or other
  misc_feature (530)..(530): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgtttttcctggggagagagccaccctctcctgtgcggccagtcagagcgttaggacgaacttagctggtatcagcagaggctggcaggctcccagactcctnatctttggctcctttaacgaggccagtggaactcccagccaggttcagcggcaggtgggtctgggacttcgtcactctcaccatcaataacctgacaatcngactactttgcttagttttattctgtcagtcagtctagaacgtctcggtccgttcgacgtttcgggacggtaagggaccaagggtccgacctacgaaacgactggngctagacactatccgtgttcttcacttccttcccgntactcg

SEQ ID NO: 5062 - DNA, 521 bp, Homo sapiens
  misc_feature: GYAE6OF01CDRK7.8.28.C06.1.454.CMB.1.raw
  modified_base (498)..(498): a, c, t, g, unknown or other
  misc_feature (498)..(498): n is a, c, g, or t
  modified_base (518)..(518): a, c, t, g, unknown or other
  misc_feature (518)..(518): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcaccatcaataacctgacaatctgacgtactttgctagtttattctgtcagtcagtctgaagtactggtccgttcacgtttcgggcgggtagggaccaaggtcggacctacgaaacgactgtggctgcacntctgtctcatcctcccgctntcg

SEQ ID NO: 5063 - DNA, 726 bp, Homo sapiens
  misc_feature: GYAE6OF01C4WOE.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctccagagatcattggagaagtggtgatgacacagtctccggtcaccctgtcttgtttttccgnggggagagacgcccaccctctcctgtcgccggccagtcagagtcgttaggactaacttagcctggtatcgagcgaggacggccgtcggccgaggcctcccgagtacctcctctattcgtttcggccgttacctttaacgacgggtacccaggttacggaacctccccgacggacccgtaggttccgacggccgggacgtagggttcggggtcgttacggggtacctttccggttaccaccttccgtaccacctactaccgtaaacttaacccgtgacctaacgttccgtacggtaaccgttacgttttcgacgtttaagtttttactttccgtgttaccaggtactacgttacgtaggaacgtaccgttcgggtcccgtttacgtaccggtttcggggacggggtacggggaacccgtaaggggttaccggtacccttaacggaaaaccggtacgttcggtacggtaccgtcgaccctaaccgtagttccgttcgttccctttactactttccctttccgtccgtcctacg

SEQ ID NO: 5064 - DNA, 516 bp, Homo sapiens
  misc_feature: GYAE6OF01DUNTM.8.28.C06.1.454.CMB.1.raw
  modified_base (195)..(195): a, c, t, g, unknown or other
  misc_feature (195)..(195): n is a, c, g, or t
  modified_base (311)..(311): a, c, t, g, unknown or other
  misc_feature (311)..(311): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgtcctttaacngggccagtggaatcccagccaggtcagcgcagtgggtctgggacttcgtcactctcaccatcaataacctgacaatctgacgtactttgctagtttattctgtcagctagtctgaagactggccttcgacgtttcggcggtagggaccaaggtcgacctacaaacgtactgtggctgcacatctgtcttcactcctcccncntcg

SEQ ID NO: 5065 - DNA, 544 bp, Homo sapiens
  misc_feature: GYAE6OF01A2LLR.8.28.C06.1.454.CMB.1.raw
  modified_base (515)..(515): a, c, t, g, unknown or other
  misc_feature (515)..(515): n is a, c, g, or t
  modified_base (540)..(540): a, c, t, g, unknown or other
  misc_feature (540)..(540): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggccgtcctttaacgagggccagtggaactcccagccaggttcagcggcagtgggtctgggacttcgtcactctcaccatcaataacctgacaatctgacgtactttgactagttttattctgtcagtcagtctgaagtctgggtccgttctacgtttcggcgggtagggtaccaagggtggaccctagaaaccgtagtggtcggctcgaccaccgtntctgttcttctatcccttcccgctntccg

SEQ ID NO: 5066 - DNA, 790 bp, Homo sapiens
  misc_feature: GYAE6OF01B8VEL.8.28.C06.1.454.CMB.1.raw
  modified_base (191)..(191): a, c, t, g, unknown or other
  misc_feature (191)..(191): n is a, c, g, or t
tcagctcgcgtgtccacgaccggtgctcgatttagagctcacgtattggggtttggggaggaactgctcagttaggacccagacggaaccatggaacgcccagcgcagcttctcttctcctgctactctggctccagagatcattggagaagtggtgatgacacagtctccggtcacctgtctgttttccnggggagagagccacctctacctgtcggcggccagtcgagagtcgttaggacgtaacttagcctaggtatcgagcagacggcctggccacggcctacccaagtacctcctcacgttccgtttggccgtaccgtttaacgagggcctaaggtcggaaactcccgaaggtcccgtaaggttcaagggccggactaagggttcgggtacgttaggggtacctttcggtaccgaacttcctaccaaaccgtaagttaacctaaaaacgttaaccctaggtaacctaaacgtaccgttaacggtaaccgttaacgttttacggtacgtttaaacggtttttaacttttaccgttagttacgtaacggtacgtaacggttacgtaacggtaaacgtaccggttccgggttacccgtttacgttaaccggttttaccggggacggggtaaaccggggaaacccggtaaacggggttaccggtaacccgttaaaccggtaaaaccggtaacggttacgggttacggtaccgtacggaaccgtaaccgttacgttaccgtttacgttaccttacctaacttcccgtttaccccgtcgtaacgttaccgg

SEQ ID NO: 5067 - DNA, 539 bp, Homo sapiens
  misc_feature: GYAE6OF01CJ47E.8.28.C06.1.454.CMB.1.raw
  modified_base (307)..(307): a, c, t, g, unknown or other
  misc_feature (307)..(307): n is a, c, g, or t
  modified_base (394)..(394): a, c, t, g, unknown or other
  misc_feature (394)..(394): n is a, c, g, or t
  modified_base (492)..(492): a, c, t, g, unknown or other
  misc_feature (492)..(492): n is a, c, g, or t
tcagctcgcgtgtccacgaccggtgctcgatttagagctcacgtattgggtttgggggaggaactgctcagttaggacccagagggaaccatggaagccccagctcagcttctcttcctcctgctactctggctcccagtttcagataccaccggagagatttgtgttgacacagtctccagccaccctgtctttgtctccaggggaaagagccaccctctcctgcaggaccagtcagaatgttggcgccttgtaagctggtaccaacacaaacctggccaggctcccaggcccctcatctatggtncatccaacagggccactggcatcccagccaggttcagtggcagtgggtatgggacaggacttcactctcaccatcatcagcctgganctagaagatgttgctagtttattactgtacaactatcgtacgagtcggcccgtaccgggggcctacgtttccggacccgtgggaaccagggtgagtanacgaaacggtaactggtcggctcgcctaccattctcgttcttctacg

SEQ ID NO: 5068 - DNA, 561 bp, Homo sapiens
  misc_feature: GYAE6OF01CBCUL.8.28.C06.1.454.CMB.1.raw
  modified_base (314)..(314): a, c, t, g, unknown or other
  misc_feature (314)..(314): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggccgtcctttaacgngggccaggtggaactccccagccaggttcagcggcaggtgggtctggggacttcgttcactctcacatcaataacctgacaatctgacgtactttgctagtttatttctgtcagctagtctggaagactgggccgtttctacgtttcgggaccgggtacgggaccgtaagggtcggtacctacgaaaccggtaacgtgtacggcgtcgccacctagtctgttcttcacttccttcccgcctagtccg

SEQ ID NO: 5069 - DNA, 601 bp, Homo sapiens
  misc_feature: GYAE6OF01DSSXS.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagacgccaccctctcctgtgcggccagtcagagcgttaggacgaacttagcctggtatcagcaggaggcctggccaggcctcccagacctcctctattctttggccgtacctttaacgacggggccaggtcggaactcccgagcctaggttcaggcggcaggtgggtctgggtacttcgtcactctcacatcaataacctgacaatctagacgtactttgacttagtttatttctgtcagctagtctagaacgtacgtcggtccgtttactacggtttcgggacgggtacgggtaaccgaagggtcggtaacctacgaaaaccgtacgtcggtacggtccgtcgtaccacctacttccgttgttacccttactacttcccttccccgtcctagttacccg

SEQ ID NO: 5070 - DNA, 560 bp, Homo sapiens
  misc_feature: GYAE6OF01CH03N.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgtggggagagagccaccctctcctgtgcggccagtcagagcgttaggacgaacttagcctggtatcagcagaggctggccaggcctcccagacctcctcatctttggcgtcctttaacgagggccaggtcggaactccccagccaggttcagcggcaggtgggtctggggacttcgtcactctcaccatcaatacctgacaatctgacgtactttgactagtttatttctgtcagctagtctagaagtctggtccgttctacgtttcgggacgggtagggaccgtaagggtcggacctacgaaaccgtacgtggtaggccgtacgccaacctgttctgttcttctacttcccttcccgcctatccg

SEQ ID NO: 5071 - DNA, 586 bp, Homo sapiens
  misc_feature: GYAE6OF01BG3DT.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacgagggccaggtcggaactcccagccaggttcagcggcaggtgggtctgggacttcgtcactctcacatacaataacctgacaatctgacgtactttgacttagttttattctgtcagctagtctagaacgtactgggtccgttctacggtttcgggacgggtacgggaccgtaagggttcggaaccctacgaaaaccggtacttggtacgggtccgtcgacctaacccgtattcccgtagtttccttctaccttccctttccccgcctacttccgg

SEQ ID NO: 5072 - DNA, 611 bp, Homo sapiens
  misc_feature: GYAE6OF01B1006.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgtaacttagcctggtatcagcagaggcctggccaggcctcccagacctcctcacttccgtttggccgtacctttaacgacgggcccaggttcggaactcccgaggcctagggttcaggcggcgtaggtcggggtccgggtacttcggttcactctcaccatacaaactacctgacaatctagtacgtactttgacttagttttattctgtcagtctaagtcctaggaacgtcgtggtacccgttcgtacggtttcgggacgggtaacgggaccgtaagggtcgaaccctacgaaacggtacgtggtacggctacgcctaccattccgtcgttcttacctacttcccttaccccgctagttccgtaacgg

SEQ ID NO: 5073 - DNA, 534 bp, Homo sapiens
  misc_feature: GYAE6OF01BZY8E.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcacatcaataacctgcaatctgacgtactttgctagtttattctgttcagcagtctgaagctggccgttcacgtttcggcgggtagggaccgaagggtggaccctacgaaacggaactcggtggctgacaccgattcctgtccttcacttccttcccgcctagtccg

SEQ ID NO: 5074 - DNA, 582 bp, Homo sapiens
  misc_feature: GYAE6OF01CSO4G.8.28.C06.1.454.CMB.1.raw
  modified_base (309)..(309): a, c, t, g, unknown or other
  misc_feature (309)..(309): n is a, c, g, or t
  modified_base (364)..(364): a, c, t, g, unknown or other
  misc_feature (364)..(364): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagccaccctctcctgtgcggccagtcggagcgttaggacgaacttagcctggtatcagcagaggcctggccaggcctccagactcctcatctttggctccttaacngggccagtggaatccagccaggtcagcggcagtggtctgggtacttcgtcactcncacatacaatacctgcaatctgactactttgctagtttattctgtcagcagtctgaagtctggtccgttctacgtttcgggacgggtaacgggtaccgtaaagggtcggaaccctacgaaaacggtaacgtgggtacggaccgtcggacctaaccctattccgttgttccctttacgaacctttccctttaccccggaccctaagtttcggaaaccgg

SEQ ID NO: 5075 - DNA, 605 bp, Homo sapiens
  misc_feature: GYAE6OF01B1PX4.8.28.C06.1.454.CMB.1.raw
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
tcagctcgcgtgtccacgaccggtgctcgatttagagctcacgtattggggtttgggggaggaactgctcagttaggacccagacggaaccatggaagccccaggcgcagcttcctcttcctcctgctactctggctcccagagatcattggacgaagtggtgatgacacagtctccggtcacccgtgtctgtttttccngggganagacgccaccctctcctgtcgccggccaggtccagacgccgttacggacgaacttacgcctggtaatcagcaggaggcctggccagggcctcccagacctcctcgatctttggccgtcctttaacgacgggccagttggaactcccgaggcctaggttcaagccggcaggtgggtctggggtacttcgttcactctcaccatcaataacctgacaatctgaacgtactttgactagttttatttctgttcaggctagtctagaagtacttcgggtccgtttctaccgttttcgggaccggggtacgggtaccgtaagggtcggaccctacgaaaacgtacgtagtacggctcgaccaccgtattcctagttcctttcacttccttccccgcctattccg

SEQ ID NO: 5076 - DNA, 532 bp, Homo sapiens
  misc_feature: GYAE6OF01CYJ3G.8.28.C06.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (481)..(481): a, c, t, g, unknown or other
  misc_feature (481)..(481): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgcctttaacngggccagtggaatcccagccaggtcagcggcagtgggctgggacttcgtcactctcaccatcaataacctgcaatctagacgtactttgctagtttactttctgtcagctagtctagaagactgggtccgttcacgttttcggacgggagggtaccaagggtcggacctanaaaacgacgtgtggctgcacctatctgtccttcacttccttcccgctatcg

SEQ ID NO: 5077 - DNA, 569 bp, Homo sapiens
  misc_feature: GYAE6OF01EBC50.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcgcagtgggtctgggacttcgtcactctcaccatcaatacctgcaatctgacgtactttgctagtttatttctgtctagctagtctgaagtacgttggccgttctaaccttttcgggaccgggtagggacccgaagggttcggaacccttacgaaaacgaacgtggtacgggtctcggccaaccgtactccgttcggttcctttcacttccctttccccgtcctacgttcg

SEQ ID NO: 5078 - DNA, 536 bp, Homo sapiens
  misc_feature: GYAE6OF01DRVQ2.8.28.C06.1.454.CMB.1.raw
  modified_base (506)..(506): a, c, t, g, unknown or other
  misc_feature (506)..(506): n is a, c, g, or t
  modified_base (532)..(532): a, c, t, g, unknown or other
  misc_feature (532)..(532): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgacaatctgacgtactttgctagtttatttctgttcagtcagtctgaagctggtccgttctactttcggcgggtacgggacctaagggtcgacctacgaaacgtacgtgtggcgtgcacctntccttgtcttcacttccttcccgccntccg

SEQ ID NO: 5079 - DNA, 521 bp, Homo sapiens
  misc_feature: GYAE6OF01EZLKX.8.28.C06.1.454.CMB.1.raw
  modified_base (518)..(518): a, c, t, g, unknown or other
  misc_feature (518)..(518): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttattctgtcagcagtctgaagtactggtccgttcacgtttcggcggtagggaccaagggtcggacctcaaacggactgtgctgcacatctgtcttctactccttcccgcctntcg

SEQ ID NO: 5080 - DNA, 534 bp, Homo sapiens
  misc_feature: GYAE6OF01C7F12.8.28.C06.1.454.CMB.1.raw
  modified_base (201)..(201): a, c, t, g, unknown or other
  misc_feature (201)..(201): n is a, c, g, or t
  modified_base (383)..(383): a, c, t, g, unknown or other
  misc_feature (383)..(383): n is a, c, g, or t
  modified_base (505)..(505): a, c, t, g, unknown or other
  misc_feature (505)..(505): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctggggacttcgtcactctcaccatcaataaccngcaatctgacgtactttgctagttttatttctgtcagcagtctagaagactggtccgttctacgtttcggcgggtagggaccaaggtcggacctacgaaacgactgtcggacgtgacacctntctgtcttcacttccttccccnctntccg

SEQ ID NO: 5081 - DNA, 650 bp, Homo sapiens
  misc_feature: GYAE6OF01EFDXJ.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacaacttagcctggtatcagcagaggcctggccaggcctcccagactcctcatctttggcgtaccttttaacgagggccagtggaactcccgagccaggttcaggcggcaggtgggtctgggacttcgtcacgtctcgaccatcaattaacctgactaatctcgtacgtactttgctagtttatttcgtgttacagtcaagttcgtagtaacgtaccgttcgggtcccgtttacgtaccgttttcgggaccggggtaacggggtaacccgtaaggggtacggtaacccgtacgtaaaaccggtaacgttcggtacgggtccgtacggtccctaacccgtacgttacccttcgtttacccgtttaccgtaacctttaccccgttttccccggtcccgtaacgtttaccccgg

SEQ ID NO: 5082 - DNA, 535 bp, Homo sapiens
  misc_feature: GYAE6OF01BTHIE.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcaccatcaataacctgcaatctgacgactttgctagtttatttctgtcagcagtctgaagtactggccgttcacgtttcgggcggtagggaccaagggtcggaccctacgaaacgaactggtggcgtcgccaccattctgttccttcacttccttccccgcctattccg

SEQ ID NO: 5083 - DNA, 589 bp, Homo sapiens
  misc_feature: GYAE6OF01CHCHZ.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttcctgggagagagcacctctcctgtgcggccagtcagagcgttaggacgaacttagcctggtatcagcagaggcctggccagcgtcccacgactcctcatctttggtcgcctttaacagggccagtggaactcccacgccgaggttcacgcgggcagtgggtcgtgggtacgttcgttcactctcaccatacaataacctgcaatctgacgtactttgctagttttaatttcttgtctagctacgtgtacgtaaggacttgggtcccgttcctaacgttttcggggccggggtaggggaacctaaaggtgggtaccctaacgaaagtaaccgtgtagggccttggaccaccgtaattccgttgtttccttaccgattcccgtttccccggcctacttacg

SEQ ID NO: 5084 - DNA, 761 bp, Homo sapiens
  misc_feature: GYAE6OF01DE6MJ.8.28.C06.1.454.CMB.1.raw
  modified_base (162)..(162): a, c, t, g, unknown or other
  misc_feature (162)..(162): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (269)..(269): a, c, t, g, unknown or other
  misc_feature (269)..(269): n is a, c, g, or t
tcagctcgcgtgtccacgaccggtgctcgatttagagctcacgtattgggtttgggggaggaactgctcagttaggacccagacggaaccatggaacgcccagcgcagcttctcttcctcctgctactctggctccagagatcaattggagaagtggtgatnacacagtctccggtcaccctgttcttgttttcgnggganagacgcccacctctcctggtcgcggccagtcagagtacgttacgggactaactcgtcgtagtactacngacgaggaccggtcgtcggccgacggtcctaccacgtccctctctactttcgttcggccttaacttacgggcgaccgtagtacggtaacctccgacgacgtcgtacgacggcggcgtaggttcggggtcttcgggttaccttcgttaccacttacccactaaccgaattaaacctaaacgttaccctgtaactacgttacgtaccgttaaacggttctttaaggttactttttaacgttttcgtaccgttcgaaccgtaggtacgttacgtacggtaacggtaacggttccggtttacggtacccgttttaccggtaacggggtttaccggggaccggggtaaacgggtaaccgtaaacggggttaccgtaaaacccggttaaacgaaaccgggttacggttccgttaacgggtcccgtcggtaaaccctacgttacgttccttaccgttaccttacccgttactttacccccggccttagtccgtaaccgg

SEQ ID NO: 5085 - DNA, 506 bp, Homo sapiens
  misc_feature: GYAE6OF01DGPUR.8.28.C06.1.454.CMB.1.raw
  modified_base (486)..(486): a, c, t, g, unknown or other
  misc_feature (486)..(486): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccagactctcatctttggcgcctttaacagggccagtggaatcccagccaggttcagcggcagtgggtctgggacttcgttcactctcaccatcaataacctgcaatctgacgatttgctagtttattctgtcagcagtctgaaagactggcgttcacgtttcggcgggtagggaccaaggtggacctcaaacgactgtggctgcacntctgtctcatcttccgcatc

SEQ ID NO: 5086 - DNA, 527 bp, Homo sapiens
  misc_feature: GYAE6OF01B863Q.8.28.C06.1.454.CMB.1.raw
  modified_base (504)..(504): a, c, t, g, unknown or other
  misc_feature (504)..(504): n is a, c, g, or t
  modified_base (525)..(525): a, c, t, g, unknown or other
  misc_feature (525)..(525): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaactcccagccaggttcagcggcagtgggtctgggacttcgtcactctcaccatcaataacctgacaatctgacgtactttgctagtttactttctgtcagctagtctgaagtactggtccttcgacgtttcggcgggtacgggaccaagggtcgactacgaaacgtactgtggctcgacacntctgtctcactcctcccgctntc

SEQ ID NO: 5087 - DNA, 748 bp, Homo sapiens
  misc_feature: GYAE6OF01DDZH4.8.28.C06.1.454.CMB.1.raw
  modified_base (138)..(138): a, c, t, g, unknown or other
  misc_feature (138)..(138): n is a, c, g, or t
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctccagngatcattggagaagtggtgaatgacacagtctccggtcaccctgtctgttttccngggganacgacgccacctctcctgtcgcggccagtcagngcgttagactacttagccttggtatcgagcaagcggcctggccacgctccagactcctactacttcgtttcggacgtacctttaacgacgggtcctacggtacggaactcccgagtccgtacggttacgacggaccggtcgtaacggttcggggttaccgttcggggtaaccgtttccggtttacgaccgttaccgttaccgtaaacccgtacgttaaccgtaaacgtttaaacccgtggtaaccgtaaacgtttccggttaacggtaaccggttaaccgttttcggtaaccgttacggttttacttaccggttcggtaaccgttacggtaccgtaacggtacgttacgtaacggtacgttcgggtaccgttcgtacgtttcgggacggtacggactacgggtaccgtaccgtaaacgtacgttcggtacggtaccgtacggtacctaaccgtacgttaacgtccggttacttcccgtaacttcccggttacccgacgttacgtccgttaaccggg

SEQ ID NO: 5088 - DNA, 540 bp, Homo sapiens
  misc_feature: GYAE6OF01ENK3N.8.28.C06.1.454.CMB.1.raw
  modified_base (195)..(195): a, c, t, g, unknown or other
  misc_feature (195)..(195): n is a, c, g, or t
  modified_base (536)..(536): a, c, t, g, unknown or other
  misc_feature (536)..(536): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggatcagcagaggcctggccaggctcccagactcctcatctttggcgcctttaacagggccagtggaatcccagccaggttcagcggcaggtgggtctggggacttcgttcactctcaccatcaataacctgacaatctgacgactttgctagtttatttctgtcagcagtctagaagtactcgggtccgtttctacgtttcggcgggtagggaccgtaagggtcggaccctacgaaacgactggtggcgtcgacaccatctgtccttcactccttcccgccntccg

SEQ ID NO: 5089 - DNA, 566 bp, Homo sapiens
  misc_feature: GYAE6OF01DBOV7.8.28.C06.1.454.CMB.1.raw
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (280)..(280): a, c, t, g, unknown or other
  misc_feature (280)..(280): n is a, c, g, or t
  modified_base (325)..(325): a, c, t, g, unknown or other
  misc_feature (325)..(325): n is a, c, g, or t
  modified_base (445)..(445): a, c, t, g, unknown or other
  misc_feature (445)..(445): n is a, c, g, or t
  modified_base (537)..(537): a, c, t, g, unknown or other
  misc_feature (537)..(537): n is a, c, g, or t
  modified_base (561)..(561): a, c, t, g, unknown or other
  misc_feature (561)..(561): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacccttgtccttgtttttccgnggggganagacgccctaccctcgtcctggtgcggccagtcaggacgtcgttaggactaacttgcctggtactcaggcaagnggcctggcaggtccaccagctctcagtctttaggctcctttaagngggccagtggaactcccaagccctaggttcaggcggtctaaggtgggtctggggctttcggtccactctcaaccatcgaaataccgtgacctaatctgaacgtctttgactatttattcngtacagctagttcagaagctgccgttctacgtttcggacgggagggtaccctaaggcgtaccgaacgaaaacgtcgtgtagctggactaccngttctagtcttcattccggtcccntagtc

SEQ ID NO: 5090 - DNA, 526 bp, Homo sapiens
  misc_feature: GYAE6OF01B6J8V.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaatcccagccaggttcagcggcagtgggtctgggacttcgtcactctcaccatcaataacctgacaatctgacgtactttgctagtttattctgtcagcagtctgaagactggccgttcacgtttcggcggtacgggaccaggtcggacctacgaaacgaactgtggcgtgcaccatctgttcttcactccttcccgcctatccg

SEQ ID NO: 5091 - DNA, 546 bp, Homo sapiens
  misc_feature: GYAE6OF01DEF8K.8.28.C06.1.454.CMB.1.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (313)..(313): a, c, t, g, unknown or other
  misc_feature (313)..(313): n is a, c, g, or t
  modified_base (346)..(346): a, c, t, g, unknown or other
  misc_feature (346)..(346): n is a, c, g, or t
  modified_base (513)..(513): a, c, t, g, unknown or other
  misc_feature (513)..(513): n is a, c, g, or t
  modified_base (540)..(540): a, c, t, g, unknown or other
  misc_feature (540)..(540): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagngcgttaggacgaacttagcctggtatcagcagaggcctggccaggcctcccagactcctcatctttggcgtcctttaacgngggccaggtggaatcccagccaggttcagcgcnggtgggtctgggacttcgtcactctcaccatcaatacctgactaatctgacgtactttgactagtttatttctgtcagtctagtctgaagtactggtccgttctacgtttcgggacgggtagggaccaaggtcggacctacgaaacgtacgtgtggcgtcgcacctntctgttccttcacttccttccccgccngttccg

SEQ ID NO: 5092 - DNA, 596 bp, Homo sapiens
  misc_feature: GYAE6OF01B7OAO.8.28.C06.1.454.CMB.1.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctccagactcctcatctttggcgcctttaacaggccagtggaactccagccaggttcagcggcagtgggtctgggacttcgttcactctcaccatacaataacctgctaatctagacgtactttgctaagttttatttctgtcagtcgtagtctagaacgtacgtcgggtccgtttactacgttttaccgggcgggtaacgggaccgtaagggtacggaccctacgaaaaccggaacgttcggtacggccgttacggcctaacctacgttccgttagttccctttactacttccctttaccccgcccgtaagttacccg

SEQ ID NO: 5093 - DNA, 588 bp, Homo sapiens
  misc_feature: GYAE6OF01BUX3O.8.28.C06.1.454.CMB.1.raw
  modified_base (343)..(343): a, c, t, g, unknown or other
  misc_feature (343)..(343): n is a, c, g, or t
  modified_base (367)..(367): a, c, t, g, unknown or other
  misc_feature (367)..(367): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaactcccagccaggttcagcgnagtggtctggggcttgttcactcncaccatcaaataacctgactaatctgacgtactttgctagtttatttctgtcagtcagttctaggaaacgtcgtcgggtccgtttacgtaccgttttcgggacggggtaacgggaaccgtaaagggtcggaaccgtaccgaaaacggtaacgttggtacgggtactcggaccacccgtattccgtacgttcctttacacttcccttccccgctacgtaccg

SEQ ID NO: 5094 - DNA, 611 bp, Homo sapiens
  misc_feature: GYAE6OF01EHUIZ.8.28.C06.1.454.CMB.1.raw
  modified_base (373)..(373): a, c, t, g, unknown or other
  misc_feature (373)..(373): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggcgtcctttaacgagggccagtcggaactcccagccaggttcagcggcaggtgggtctgggacttcgtcactcncaccatacaataacctgactaatctgacgtactttgcttagtttatttctgttcagtctagtctaggtaagactcgggtccgtttcgtaacgtttcggggaccgggtaaggggtacccgtaaggggtaccggtaacccgtaaccgaaaaccggtaacgttgggtacggccgtacggaccacccgtacttccgttaggttcctttacctactttacccttcccccgtcctaacttccgg

SEQ ID NO: 5095 - DNA, 595 bp, Homo sapiens
  misc_feature: GYAE6OF01A9WAO.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaatcccagccaggttcagcggcagtggtctgggacttcgtcactctcacatcaataacctgacaatctgacgtactttgctagtttatttctgtcagtctagtctagaacgacgtgggtacccgtttcgacgttttcggggacgggtacggggtaacccgtaaagggtcgggaaccctacgaaaccggaaacgttcggtacgggtcgtcggtaccacccgtattcccgttaggttccctttactacgtttccctttcccccgccctagttcccg

SEQ ID NO: 5096 - DNA, 561 bp, Homo sapiens
  misc_feature: GYAE6OF01C8D40.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagcccaccctctcctgtgcggccagtcagagcgttaggacgaacttagcctggtatcagcagaggcctggccaggctcccagactcctcattctttggcgtcctttaacgacgggccaggtggaactcccgagccaggttcagcggcagtgggtctgggacttcgtcactctcaccatcaataacctgcaatctgacgtactttgcttagtttatttctgtcagtctagtctagaagacgttggtccgttcgtacgtttccgggacgggtacgggtaccgtaagggtcggacctacgaaaccgacgtggtggctggaccacctatccttgtcttcacttcccttcccgcctagtccg

SEQ ID NO: 5097 - DNA, 518 bp, Homo sapiens
  misc_feature: GYAE6OF01BNX4P.8.28.C06.1.454.CMB.1.raw
  modified_base (491)..(491): a, c, t, g, unknown or other
  misc_feature (491)..(491): n is a, c, g, or t
  modified_base (514)..(514): a, c, t, g, unknown or other
  misc_feature (514)..(514): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcaccatcaataacctgcaatctgacgactttgctagtttattctgtcagcagtctgaagactggccgttcacgtttcgggcgggtagggaccaaggtcggacctcaaacgactgtggctgcacntctgtcttcactccttcccgctntccg

SEQ ID NO: 5098 - DNA, 605 bp, Homo sapiens
  misc_feature: GYAE6OF01BADOJ.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (356)..(356): a, c, t, g, unknown or other
  misc_feature (356)..(356): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcggttaggacgaacttagccttggtatcagcagaggcctggccaggcctcccagacctcctcattctttgggccgtacctttaacgacgggccaaggtcggaactcccagccaggttcaggcgntaggtggggtctgggacttcgtcactctacacatcaataacctgacaatctagacgtactttgacttagtttattcagtcagtctagtcgtaggacgtcgtcggtccgtttctaccggtttcgggacggtaacgggtaccaagggttacggaccttaacgaaacggtactgggtacggtcgtggccctaactcgttaccgttacgttaccttccgaactttccccgtaccccggtcctaacgtttccgg

SEQ ID NO: 5099 - DNA, 585 bp, Homo sapiens
  misc_feature: GYAE6OF01AUCSE.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagccaccctctcctgtgcggccagtcagagcgttaggacgaacttagcctggtatcagcagaggcctggccaggcctcccagacctcctcattctttggccgtccctttaacgaggggccaggtggaactcccagccaggttcaggcggcaggtgggtctgggtacttcgtcactctcacatacaatacctgactaatctagacgtactttgcttagttttatttctgtcagtctagtctagaagtacgttggtccgttctaccgtttccgggacgggtacgggtaaccgaagggtcggaaccctacgaaaccgtaacgttggtacggtcgtcgaccaccgtacttcgtgttccttctacttccctttccccgctactccg

SEQ ID NO: 5100 - DNA, 542 bp, Homo sapiens
  misc_feature: GYAE6OF01CDHB1.8.28.C06.1.454.CMB.1.raw
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
  modified_base (539)..(539): a, c, t, g, unknown or other
  misc_feature (539)..(539): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctccagactcctcatctttggcgtcctttaacgagggccagtggaactcccagccaggttcagcggcagtgggtctgggacttcgtcactctcacatcaatactgcaatctgacgtactttgactagtttatttctgtcagctagtctagaacgtacgtcggtccgtttctaccgtttcgggacgggtagggaccgtaagggtcggaccgtacgaaacgaacgtcggtggctcgacacntctntcttcacttcctcccgctntcg

SEQ ID NO: 5101 - DNA, 524 bp, Homo sapiens
  misc_feature: GYAE6OF01DZ77B.8.28.C06.1.454.CMB.1.raw
  modified_base (201)..(201): a, c, t, g, unknown or other
  misc_feature (201)..(201): n is a, c, g, or t
  modified_base (341)..(341): a, c, t, g, unknown or other
  misc_feature (341)..(341): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgtcctttaacgagggccagtggaatcccagccagtcagcgnagtgggtctgggacttcgtcactctcaccatcaataacctgacaatctgacgtactttgctagtttatttctgtcagctagtctgaagtactggtccgtttcacgtttcggcgggtagggaccgtaagggtcgaccgtacaaacgtactgtggctgcacatctgtcttcactctcccncntcg

SEQ ID NO: 5102 - DNA, 670 bp, Homo sapiens
  misc_feature: GYAE6OF01C88C1.8.28.C06.1.454.CMB.1.raw
tcagctcgcgtgtccacgaccggtgctcgatttagagctcacgtattggggtttgggggaggaactgctcagttaggacccagacggaaccatggaagccccagcgcagcttctcttctcctgctactctggctccagagatcattggagaagtggtgatgacacagtctccggtcaccctgtctgtttttcctggggagagagccacctctcctgtgcggccagtcagagcgttaggacgtaacttagcctggtatcagcagaggcctggccaggcctcccgagacctcctcacttccgtttggaccgtacctttaaacgagggcccaggtacggaactccccgaggcccgtaaggttccgaggtcggcaaggttcggggttctggggtactttcggtaccacgttcctccgaaccctattaacccaaacttaaacctgacctaatcctacgaccgttactttagacttaagttttacttctgtctagtcagttctacgaacgtctcgggtccctttacgtacggtttcgggaccgggtagggaacccgtagggtaccggaccgtaacgtaaaaccggtctagggtacggtaccgttggacccttaaccgacgttccgttaggttccctttacaccgtttacccgtttcccccggacctagttacccgg

SEQ ID NO: 5103 - DNA, 528 bp, Homo sapiens
  misc_feature: GYAE6OF01C6WJJ.8.28.C06.1.454.CMB.1.raw
  modified_base (195)..(195): a, c, t, g, unknown or other
  misc_feature (195)..(195): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (522)..(522): a, c, t, g, unknown or other
  misc_feature (522)..(522): n is a, c, g, or t
  modified_base (525)..(525): a, c, t, g, unknown or other
  misc_feature (525)..(525): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgcctttaacgagggccaggtggaactcccagccaggtcagcggcagtgggtctgggacttcgtcactctcacatcaataacctgcaatctgacgtactttgacttagttttatttctgtcagtctagtctgaatctggtccgttctacgtttcgggcgggtagggaccgaagggtcgactacgaaacgactggtgctgcactntctntcttcacttcctccnctntcg

SEQ ID NO: 5104 - DNA, 671 bp, Homo sapiens
  misc_feature: GYAE6OF01EO2EB.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (376)..(376): a, c, t, g, unknown or other
  misc_feature (376)..(376): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgcccttttaacgaggggccaggtgggaactccccgagccaggttcagcggcagtgggtctgggacttcgtcactcncaccatcaataacctgcaatctgacgtactttgctagtttatttctgtcagtctagtctagaagtactcgggtaccgtttcgtaaccgttttccggggaccggggtaacggggtaacccgtaaacggggttacgggtaaccccgttaaccgaaaaacccggtaaaccgttcgggttacgggtacccgttacgggaccctaaacccgttacgttacccgtttacggtttacccgttttacccgtaacccgttttccccgtttacccccccgggtacccctaacggtttaaccccgg

SEQ ID NO: 5105 - DNA, 533 bp, Homo sapiens
  misc_feature: GYAE6OF01CL3VD.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (378)..(378): a, c, t, g, unknown or other
  misc_feature (378)..(378): n is a, c, g, or t
  modified_base (508)..(508): a, c, t, g, unknown or other
  misc_feature (508)..(508): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcattctttggctcctttaacgagggccagtggaactcccagccagtcagcgcagtggtctgggacttcgtcactctcacatcaataccngacatctagactactttgctagtttattctgtcagctagtctagaacgtcgtcggtcctttcgtaacgtttcgggacgggtacgggacctaagggtacgacctacgaaacgtacgtgtaggctgacactntctgtcttcactcttcccgntntcg

SEQ ID NO: 5106 - DNA, 618 bp, Homo sapiens
  misc_feature: GYAE6OF01B2F90.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggcccaggcctcccagacctcctcattcgtttgggccgtccctttaacgaggggccaaggttcggaaactccccagccaggttcaggcggcaggtgggtctggggacttcgttcactctcaccatcaatacctgcaatctgacgtactttgactagtttatttctgtcagctagtctagtaagtacgtgggtccgttactacggttttcgggcgggtaacggggaacccgtaaggggttcggaacccgtaacgaaaaccggtaacgtcggtaggccgtcggtacccaacctacttcccgttacggttacctttccgtactttcccgtttaccccgtcgttacgttccg

SEQ ID NO: 5107 - DNA, 583 bp, Homo sapiens
  misc_feature: GYAE6OF01EFKRW.8.28.C06.1.454.CMB.1.raw
  modified_base (212)..(212): a, c, t, g, unknown or other
  misc_feature (212)..(212): n is a, c, g, or t
  modified_base (344)..(344): a, c, t, g, unknown or other
  misc_feature (344)..(344): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctntcctgtgcggccagtcagagcgttaggacgaacttagcctggtatcagcagaggcctggccaggctcccagacctcctcatctttggcgtcctttaacgagggccagtggaatcccagccaggttcagcggnagtggtctgggacttcgtcactctcaccatcaatacctgacaatctgactactttgctagtttatttctgtctagctagttctagaacgtactgggtccgttcgtacgtttcgggacgggtacgggtaccaagggtcgtacccgtacgaaaacgtacgtagggttacggtcgtacggacccaaccgtatccgttaggttacctttactacttccctttaccccggtccctagttacccg

SEQ ID NO: 5108 - DNA, 566 bp, Homo sapiens
  misc_feature: GYAE6OF01BA8J3.8.28.C06.1.454.CMB.1.raw
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggcgcctttaacngggccaggtggaatcccagccaggttcagcggcagtgggtctgggacttcgtcactctcaccatcaatacctgcaatctgacgtactttgctagtttatttctgtcagtcagtctgaacgtactcgggtccgtttctaccgttttcggggaccgggtacgggacccgtaaggggtcggaccgtacgaaacgaaccttggtggaccgtgaccaccgtattcctgttccttcacttcccttcccggtccctattccg

SEQ ID NO: 5109 - DNA, 547 bp, Homo sapiens
  misc_feature: GYAE6OF01AOUQI.8.28.C06.1.454.CMB.1.raw
  modified_base (302)..(302): a, c, t, g, unknown or other
  misc_feature (302)..(302): n is a, c, g, or t
  modified_base (541)..(541): a, c, t, g, unknown or other
  misc_feature (541)..(541): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagccaccctctcctgtgcggccagtcagagcgttaggacgaacttagcctggtatcagcagaggcctggccaggctcccagactcctcatctttggcncctttaacagggccactggcatcccagccaggttcagtggcagtgggtatgggacagacttcactctcaccatcatcagcctggagcctgaagatgttgctagtttattactgtacaacatcgtaccgtagtcggccgtccggggtcctaccgtttccggcccgttcgggacccgaagggtcgggacgacgtacgaaaccggtaacgtggtacggtctcgccacctactctgtccttcnttcccg

SEQ ID NO: 5110 - DNA, 541 bp, Homo sapiens
  misc_feature: GYAE6OF01B0E3H.8.28.C06.1.454.CMB.1.raw
  modified_base (197)..(197): a, c, t, g, unknown or other
  misc_feature (197)..(197): n is a, c, g, or t
  modified_base (506)..(506): a, c, t, g, unknown or other
  misc_feature (506)..(506): n is a, c, g, or t
  modified_base (516)..(516): a, c, t, g, unknown or other
  misc_feature (516)..(516): n is a, c, g, or t
  modified_base (537)..(537): a, c, t, g, unknown or other
  misc_feature (537)..(537): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagattcattggagaagtggtgatggacacagtctccggtcacctgtctgtttttccgnggggagagacgccaccctctcctgtgcggccagtccaggacgcgttaggacgtaaccttagcctggtatcagcagaggcctggccaggctcccagacctcctcatctttggcgcctttaaacgagggccagtggaactcccagccaggttcagcggcagtgggtctggggacttcgtcactctcacatcaatacctgcaatctagacgactttgctagttttattctgtcagcagtctgaagtactggccgttctacgttttcgggcgggtagggacctaagggttcggacctacaaacggaacttggnggctgcaccntctgtcttcattcctcccgcngtcg

SEQ ID NO: 5111 - DNA, 540 bp, Homo sapiens
  misc_feature: GYAE6OF01AWWGD.8.28.C06.1.454.CMB.1.raw
  modified_base (309)..(309): a, c, t, g, unknown or other
  misc_feature (309)..(309): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggctcctttaacngggccagtggaactcccagccaggttcagcggcaggtgggtctgggacttcgtcactctcacatcaatacctgactaatctagacgtactttgctagtttattctgtcagtctagtctgaacgtctcggtccgttcgacgtttcgggacgggtacggaccgtaagggtcgacctacgaaacgtacgtgtcggctcgacacgtatctcgtcttcacttccttcccgctgtcg

SEQ ID NO: 5112 - DNA, 529 bp, Homo sapiens
  misc_feature: GYAE6OF01AJ577.8.28.C06.1.454.CMB.1.raw
  modified_base (310)..(310): a, c, t, g, unknown or other
  misc_feature (310)..(310): n is a, c, g, or t
  modified_base (500)..(500): a, c, t, g, unknown or other
  misc_feature (500)..(500): n is a, c, g, or t
  modified_base (525)..(525): a, c, t, g, unknown or other
  misc_feature (525)..(525): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccagtggaatcccagccaggttcagcggcagtgggtctgggacttcgtcactctcaccatcaataacctgacaatctgacgtactttgctagtttatttctgtcagcagtctgaagactggtccttcacgtttcgggacggtacgggaccaagggtcggacctacgaaacgactgtcggctcgcacntcctgtccttcactccttcccgctntccg

SEQ ID NO: 5113 - DNA, 542 bp, Homo sapiens
  misc_feature: GYAE6OF01E39OC.8.28.C06.1.454.CMB.1.raw
  modified_base (303)..(303): a, c, t, g, unknown or other
  misc_feature (303)..(303): n is a, c, g, or t
  modified_base (396)..(396): a, c, t, g, unknown or other
  misc_feature (396)..(396): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctccgtgtgcggccagtcagagcgttaggacgaacttagcctggtatcagcagaggcctggccaggctcccagactcctcatctttggccncctttaacagggccagtggaactcccagccaggttcagcggctaggtggtctgggacttcgttcactctcaccatcaataacctgcaatctanacgtactttgctagtttattctgtcagcagtctgagactggccgttcacgtttcggcggaggaccgaaggtcggacctacgaaacgacgttgaggtctcggacaccgattcgtgttacttcacttcccttccccggtctagttccg

SEQ ID NO: 5114 - DNA, 649 bp, Homo sapiens
  misc_feature: GYAE6OF01C8RUY.8.28.C06.1.454.CMB.1.raw
  modified_base (195)..(195): a, c, t, g, unknown or other
  misc_feature (195)..(195): n is a, c, g, or t
  modified_base (202)..(202): a, c, t, g, unknown or other
  misc_feature (202)..(202): n is a, c, g, or t
  modified_base (361)..(361): a, c, t, g, unknown or other
  misc_feature (361)..(361): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggganagacgccaccctctcctgtgcggccagtcagagcgttaggacaacttagcctggtatcagcagaggcctggccaggctcccagactcctctattcgtttggccgtacctttaacgaggggccagtggaactcccagccaggttcagcgcgagtgggtcngggacttcgtcactctcaccatcaatacctgacaatctagacgtctttagcttagtttatttctgtcagctaggtctaggtaacgtacgttcgggtcccgtttacgtaaccgttttccggggacggggtaacggggtaacccgtaaaggggttccgggtaacccgtaacgtaaaaacccggtaaaccgttgggtaccgggtcgttaccgggtaccctaacccgttaacgttccgttcgtttccctttaccgtaaccgtttccctttccccccgtactacgttacccgg

SEQ ID NO: 5115 - DNA, 526 bp, Homo sapiens
  misc_feature: GYAE6OF01AVCMS.8.28.C06.1.454.CMB.1.raw
  modified_base (301)..(301): a, c, t, g, unknown or other
  misc_feature (301)..(301): n is a, c, g, or t
  modified_base (441)..(441): a, c, t, g, unknown or other
  misc_feature (441)..(441): n is a, c, g, or t
  modified_base (496)..(496): a, c, t, g, unknown or other
  misc_feature (496)..(496): n is a, c, g, or t
  modified_base (522)..(522): a, c, t, g, unknown or other
  misc_feature (522)..(522): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcncctttaacagggccagtggaatcccagccaggttcagcggcaggtgggtctgggacttcgttcactctcaccatcaatacctgacaatctagactactttgctagttttattctgtcagcagtctgaacactggccgttnactttcgggcggtagggaccaggtggacctacgaaacgactgtcggctcgcaccnttctgttcttcacttccttcccgctntccg

SEQ ID NO: 5116 - DNA, 520 bp, Homo sapiens
  misc_feature: GYAE6OF01C8K8D.8.28.C06.1.454.CMB.1.raw
  modified_base (379)..(379): a, c, t, g, unknown or other
  misc_feature (379)..(379): n is a, c, g, or t
  modified_base (509)..(509): a, c, t, g, unknown or other
  misc_feature (509)..(509): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacaggccagtggatcccagccaggttcagtgcagtggtatgggacagacttcactctcacatcatcagctggngctgaagatgtgctagtttattactgtacaactatcgtacgagtcggccgtccggggcctacgttcggcccgtcgggaccgaggtggagactacgaaacgacgtggtggctgccaccactctcgtcttcnctccttccccg

SEQ ID NO: 5117 - DNA, 526 bp, Homo sapiens
  misc_feature: GYAE6OF01C2GA0.8.28.C06.1.454.CMB.1.raw
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctggggacttcgttcactctcaccatcaaataacctgcaatctgacgtactttgctagtttatttctgtcagcagtctgaagctgggccgttcacgtttcggcggagggacccaagggtcggacctcgaaaacgaactggtggctgcaccgatctgtcttcatccttcccnctntcg

SEQ ID NO: 5118 - DNA, 531 bp, Homo sapiens
  misc_feature: GYAE6OF01BLTM7.8.28.C06.1.454.CMB.1.raw
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (440)..(440): a, c, t, g, unknown or other
  misc_feature (440)..(440): n is a, c, g, or t
  modified_base (499)..(499): a, c, t, g, unknown or other
  misc_feature (499)..(499): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcncctttaacngggccagtggaatcccagccaggttcagcggcagtgggtctgggacttcgtcactctcaccatcaatacctgacaatctagacgtactttgctagttttattctgtcagtcagtctgaagctggtccttnacgtttcgggcggagggaccaagggtcgacctacgaaacgactggtggctcggcacctntcgtgtccttcacttccctcccgctagttccg

SEQ ID NO: 5119 - DNA, 632 bp, Homo sapiens
  misc_feature: GYAE6OF01C55GT.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggcaggctccagactcctcattcctttggcgtaccctttaacgacgggtcccaaggttcgggaaacttccccgaagcccgaggttcaggcggccgaggttgggtctgggactttcgttcactctcaaccatacaataaacctgacaacttctagaccgtatttcgctagttttattcgtgtacagctagtctagaacgtactcgggtccgtttacgtaccgtttacgggaccgggtaaggggtaacccgtaaagggttccggaacccttacgaaaacgtacgtcggtaggccgttaggacctaaccctattccgttacgttccgttccgtaacttcccgtttccccggcctacgttacccgg

SEQ ID NO: 5120 - DNA, 592 bp, Homo sapiens
  misc_feature: GYAE6OF01BESVY.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagttggtgatgactacagtctccggtcaccctgtctgtttttcctggggagagagccgaccctctcctgtgcggccagtcagagcgttaggacgaacttagcctggtactcagcagaggcctggccaggctcccagactcctcatctttggcgcctttaacagggccaggtggaatcccagccaggttcagcggcagtgggtctgggacttcgtcactctcaccatcaataacctgcaattctgacgtactttgactaagtttatttctacgtctacgctacgttctagaacgtactcggtccgtttccgtaacttttccgggaccgggtaagggtaacccgtaacgggtcggacctaccgaaaccgtaacgttcggtacggtctcggacaccgtattccgttagttccttacacttcctttccccgctacgttacccgg

SEQ ID NO: 5121 - DNA, 520 bp, Homo sapiens
  misc_feature: GYAE6OF01EQ0R8.8.28.C06.1.454.CMB.1.raw
  modified_base (495)..(495): a, c, t, g, unknown or other
  misc_feature (495)..(495): n is a, c, g, or t
  modified_base (517)..(517): a, c, t, g, unknown or other
  misc_feature (517)..(517): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggtcagcgcagtggtctgggacttcgtcactctcaccatcaataacctgcaatctagacgtactttgctagtttattctgtcagcagtctagaagactggtccgttcacgtttcgggcgggtagggaccaagggtcgacctacgaaacgaactgtgcgtgcacntctgtctcactcttcccgcctntcg

SEQ ID NO: 5122 - DNA, 605 bp, Homo sapiens
  misc_feature: GYAE6OF01BCJQX.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggctcctttaacagggccagtggaactcccagccaggttcagcggcaggtgggtctgggacttcgtcactctcaccatcaatacctgacaatctgacgtactttgctagtttactttctgtctagctagtcgtagaagtacgtcgggtcccgtttcgtaccgttttcgggaccggggtacggggtaacccgtaagggttacggtacccgtaccgtaaaaccggacgttacggtcgggtaccgttggaccctaccgtacgttccgttcgttacccttcctacttccccgttccccgtcctaacgttccg

SEQ ID NO: 5123 - DNA, 620 bp, Homo sapiens
  misc_feature: GYAE6OF01DGSDK.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtaggtgatgacacagtctccggtcaccctgtctgtttttcctggggagagagccaccctctcctgtgcggccagtcagagcgttaggacgaacttagcctggtatcagcagaggcctggccaggctcccagacctcctcattcgtttggcgtcctttaaacgaggggccaggtcggaactccccaagccaggttcaggcggcaggtgggtctgggacttcgtcactctcacatcaaatacctgacaatctagaccgtactttgacttagtttactttctagtcagtctacgtctaggtaacgtacgtcggtaccgtttcgaccgttttcgggaccgggtaagggtacccgaagggtacggacccgttaacggaaaaccggtaacgtcgggtacggccgttacggcctaaccgtacttccgttaggttacctttaccacttccgtttccccggacctacgtacccgg

SEQ ID NO: 5124 - DNA, 623 bp, Homo sapiens
  misc_feature: GYAE6OF01C6H5S.8.28.C06.1.454.CMB.1.raw
  modified_base (579)..(579): a, c, t, g, unknown or other
  misc_feature (579)..(579): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgttttcctggggagagagcccaccctctcctgtgcggccagtcagagcgttaggacgaacttagcctggtatcagcagaggcctggccagggcctcccgagacctcctctacttcttttacggccgtacccttttaaaccgaggggcccaggttcggaaacttccccgagcccctaaggttcaaggcgggcaggtggggtcctaggggacctttcgttcacttctacaccattacaacttaaacctgaccaatctgaacgtactttgcttagtttacttctgtcagactagtctagaagtctggtccgttacgtacgttccgggacgggtacgggaaccgtaagggtcgaaccgtacgtaaaacgacgtacggtaggcgtcggcctaaccgtnttccgtagttcccgttactacttacctccccgtcctagttcccg

SEQ ID NO: 5125 - DNA, 577 bp, Homo sapiens
  misc_feature: GYAE6OF01B0XJO.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaactcccagccaggtcagcggcagtgggtctggggacttcgtcactctcacatcaatacctgcaatctgacgtactttgctagtttacttctgtcagctagtctagaagtctgggtccgtttctaccgtttcgggacgggtagggtaccgtaggtacgggacccttacggaaacgtaccgtggtacggtcgtacggcctaacccgtcttccgttgttaccctttcgacctttccctttcccccgtccttacgttcccg

SEQ ID NO: 5126 - DNA, 535 bp, Homo sapiens
  misc_feature: GYAE6OF01C3NFW.8.28.C06.1.454.CMB.1.raw
  modified_base (291)..(291): a, c, t, g, unknown or other
  misc_feature (291)..(291): n is a, c, g, or t
  modified_base (532)..(532): a, c, t, g, unknown or other
  misc_feature (532)..(532): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagccaccctctcctgtgcggccagtcagagcgttaggacgaacttagcctggtatcagcagaggcctggccaggctcccagactccncatctttggcgcctttaacacgggccagtggaactcccagccaggttcagcggcaggtgggtctgggacttcgtcactctcacatcaataacctgacaatctagacgtactttgctagttttatttctgtcagctagtctagaagtactggtccgttctacgtttcggcggtagggaccgaaggtcggacctacgaaacgtactgtgcgtcgcaccatctgttctctactccttcccgctntcg

SEQ ID NO: 5127 - DNA, 545 bp, Homo sapiens
  misc_feature: GYAE6OF01B6JTE.8.28.C06.1.454.CMB.1.raw
  modified_base (309)..(309): a, c, t, g, unknown or other
  misc_feature (309)..(309): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgtagacgaacttagcctggtatcagcagaggcctggccaggctcccagactcctcatctttggcgtcctttaacngggccagtggaactcccagccaggttcagcggcaggtgggtctgggacttcgtcacgtctcaccatcaataacctgacaatctagacgtactttgctagtttacttctgtcagtctagtctagaacgtactggtccgttcacgtttcggacgggtagggacctaagggtcggacctacgaaacgtaactgtggtcgtgcacctatcgtgtccttctacttcctcccgtctacgtcg

SEQ ID NO: 5128 - DNA, 594 bp, Homo sapiens
  misc_feature: GYAE6OF01BO5IC.8.28.C06.1.454.CMB.1.raw
  modified_base (314)..(314): a, c, t, g, unknown or other
  misc_feature (314)..(314): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacaacttagcctggtatcagcagaggcctggccaggctcccagacctcctcattctttggccgtcctttaacgnggggccaggtcggaactcccagccaggttcaggcggcgaggtgggtctggggtacttcgtcactctcacatcaataccngacaatcngacgtactttgcttagtttattctgtcagtctagtctagaacgtcgtcgggtaccgtttcgtaccgtttcggggaccgggtacgggaaccgtaagggtccggaacctaccgaaaaccggtacgttggtacggtcgtcgactacccgtattccgtcgttaccttcgaccttacccgttccccgccttcgtaccg

SEQ ID NO: 5129 - DNA, 624 bp, Homo sapiens
  misc_feature: GYAE6OF01COSFW.8.28.C06.1.454.CMB.1.raw
  modified_base (201)..(201): a, c, t, g, unknown or other
  misc_feature (201)..(201): n is a, c, g, or t
  modified_base (393)..(393): a, c, t, g, unknown or other
  misc_feature (393)..(393): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggcctcccagactcctcatctttggcgcctttaacgaggccaggtggaactcccagccaggttcagcggcagtgggtctgggacttcggtcactctcaccatacaatacctgcaatcngactactttgcttagtttatttctgtcagtccagtctagtaacgacttcggtccggttactaccgttttcgggaccgggtaacggggacctaacggggttacggtaaccgtacgaaaaccggtaaacgttcggtacgggtaccttaggaccctaaccccgtagttacccgttcggtttaccgtttccgttaaacccgttccctttacccccgggcccttagttaacccggg

SEQ ID NO: 5130 - DNA, 579 bp, Homo sapiens
  misc_feature: GYAE6OF01A7L96.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcatctttggcgtacctttaacgaggggccaggtcggaactcccgagccaggttcaggcggcagtgggtctgggacttcgtcactctcaccatacaatacctgacaatctagacgtactttgctagtttattctgtcagtctagtctagaacgtcgtcggtccgttctacgtttccgggacgggtaacgggtaccgtaagggtacggaccttacgaaaaccggtaacgtggtacggcgtacgaccacctgttccgttgttccttccacttacccttcccgcctatccg

SEQ ID NO: 5131 - DNA, 619 bp, Homo sapiens
  misc_feature: GYAE6OF01D7MQP.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagacgccaaccctctcctggtgcggcagtccaggagcgttaggacaacttgcctggtatcagcagaggcctggccaggcctccagactcctcattcgtttggccgtacctttaacgacgggcccaagttcggaaacttccccagccctaggttcaggcggctaggtgggtctgggtacttcgtcacgtctcaccatacaatacctgactaatctgactactttgactagtttattctgtctagctacgttctaggtaacgtacgtggtaccttcgtaacgtttcgggacgggtaacgggaccgtaagggtacgtaccttacgaaaacggtacgtcggtacggtccgtcgaccctaacctacgttccttacggtttccctttacgtacccttacccgtttccccgccgtagttacccgg

SEQ ID NO: 5132 - DNA, 580 bp, Homo sapiens
  misc_feature: GYAE6OF01ENUIY.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggctcctttaacagggccagtggaatcccagccaggttcagcggcagtgggtctggggacttcgtcactctcaccatcaatacctgacaatctgacgtactttgctagtttactttctgtcagtctagttctgaagtacgttgggtccgttcgtaccgttttcgggcgggtaacgggaccgtaagggtcggtaaccctacgaaaccggtaacgttggtacggccgtcgaccgtaccctagttccgttcgttccttacacttcccttccccgtcctagttacccg

SEQ ID NO: 5133 - DNA, 523 bp, Homo sapiens
  misc_feature: GYAE6OF01BD7HG.8.28.C06.1.454.CMB.1.raw
  modified_base (520)..(520): a, c, t, g, unknown or other
  misc_feature (520)..(520): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcaccatcaataacctgcaatctgacgactttgctagtttattctgtcagctagtctagaagctggccgttcacgtttcgggcgggtagggaccgaaggtcggacctacgaaacgactgtaggctgacacatctgtcttcactccttcccgctntcg

SEQ ID NO: 5134 - DNA, 703 bp, Homo sapiens
  misc_feature: GYAE6OF01DM7MY.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgccggccagtcagagcgttaggacgtaacttagcctggtatcagcagaggcctggccaggctcccagacctcctctattcgtttcggccgtcctttaacgacggggtccaggtcggaactccccggagcccgtaggttcacggcggacgtaggttcggggtcgtaggggtacctttcggtttccaccgttcctaccgtacctactacctaaacttaaccctaggacctaacgttcctaggtaaccgttacgttttacggtactttaaggtttttacttttaccgttacgttaccgtagtaccgtagttacgttaggtaacgtacgtcgggtacccgtttacgtaacggtttccgggacgggtaacgggaaccgtaacgggtacggaccgtaacgaaacggtacgtcggtacggacgtcgacctaaccgtcgttaccgttcgttaccttccgtaccttccccgttaccccgtcctacgttacccg

SEQ ID NO: 5135 - DNA, 867 bp, Homo sapiens
  misc_feature: GYAE6OF01B06CY.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagacgccaccctctcctgtgcggccagtcagagcgttaggacgaacttagcctggtatcagcaggacggcctggcccaggcctacccgagacctcctacgtattccgtttgggccgtacctttaaaccgacggggccctaggtcggaaacctccccgaagcccgtaagggttccacggcggctagggttcggggttccgtagggggtacctttccggtttaccaaccttccgtacctaaccctaattacctaaaacgttaaccctgtacctaaacgttaccgttacggtaaccgttaacgttttcgtaccgtttaaggtttttaacttttcgttacggttacgtacggtacttacggttaccgttaaggtaaacggttaccggttaccgggttacccggttttacgttaacccgggttttccgggggaaccgggggtaaaccggggtaacccggttaaacgggggtttacccgggtaaaccccggttaaaccggtaaaaacccgggttaaccggttaccgggttaaccggggtacccgttaaccgggtaccccttaaaccccggttaacgtttaccccggtttaccggtttaaccccgttttacccttaacccggttttacccccgtttaccccccggtaacccggttaaccgttttaaccccggg

SEQ ID NO: 5136 - DNA, 658 bp, Homo sapiens
  misc_feature: GYAE6OF01D9KVM.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagcccaccctctcctgtgcggccagtcagagcgttaggacgtaacttagcctggtatcagcaggacggcctggccaggcctcccgagacctcctctattcgtttgggccgtacctttaacgaggggtccaggtcggaactcccgagcctaggttcgaggccggcgaggtcgggtcgtcggggtactttcggtccacttctccgacctatactaaactaaccctgtacctaattcgtacgtaccgttactttacgtacttaagtttttactttcgtacgttactacgtctacgttcgtaggaacgtacgttcgggtcccgtttacgtaccggtttcgggaccggggtacgggtaaccgtaagggtaccgaccgtaacgaaacgtacgtcggtacggtacgtcgaccacctcttccgttacgttccttactacttcccttcccgtctacgttccg

SEQ ID NO: 5137 - DNA, 597 bp, Homo sapiens
  misc_feature: GYAE6OF01ED3BW.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctccagacctcctcatctttggccgtcctttaacgngggccagtcggaactcccagccaggttcagcggcagtggtctgggacttcgtcactctcacatcaataaccctgactatctagacgtactttgactagtttattctgtcagtctagtctgaagactggtccgttctacgtttcggacgggtacgggacctaagggtacgacccgtacgaaaccggtaacgttcggtacggtccgtacggacctaacccgtacttccgttacggttaccctttacgtacgttaccccgtttacccccgcccgtaacgttacccgg

SEQ ID NO: 5138 - DNA, 574 bp, Homo sapiens
  misc_feature: GYAE6OF01BBVXJ.8.28.C06.1.454.CMB.1.raw
  modified_base (372)..(372): a, c, t, g, unknown or other
  misc_feature (372)..(372): n is a, c, g, or t
  modified_base (561)..(561): a, c, t, g, unknown or other
  misc_feature (561)..(561): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttcctggggagagacgccaccctctcctgtgcgccagtcagagcgttaggacgaacttagccgtggtatcagcagaggcctggccaggcctcccagactcctcatcgtttggccgtcctttaacgagggccagtggaactccagccaggttcagcggcaggtggctgggacttcgtcactcncacatacaacgtactgacaatctagacgtactttgcttagtttatttctgtcagtcagtacgtagtaacgtcgtcggtccttctacgttccgggacgggacgggaaccgtaagggtacggacctacgaaaccggtacgtaggtcgacgtcgaccacgtactcgttctaccttcgacttcccgttacccnccgtacttaccgg

SEQ ID NO: 5139 - DNA, 533 bp, Homo sapiens
  misc_feature: GYAE6OF01CBDBG.8.28.C06.1.454.CMB.1.raw
  modified_base (443)..(443): a, c, t, g, unknown or other
  misc_feature (443)..(443): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccagactcctcatctttggcgcctttaacagggccagtggaatcccagccaggttcagcggcagtgggtctggggacttcgttcactctcaccatcaataacctgcaatctgacgactttgctagtttatttctgtcagtcagtctgaacgatcgggtcccttntaaccgttttcgggaccgggtagggaccgaagggtgacccttcgaaacgtactgtggctcgcaccatctgtcttcatccttcccgntntc

SEQ ID NO: 5140 - DNA, 595 bp, Homo sapiens
  misc_feature: GYAE6OF01BACEH.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcattcgtttggcgtcctttaacgacgggccaggtggaactccccgagccaggttcgagtcggcaggtgggtctggggtacttcgtcactctcaccatcaaataacctgactaatctcgacgtactttgcttaagtttatttctgtcagtcagtctaggaagtcgtggtccgttctacgtttccgggcgggtaacgggaccgtaagggtcggaacccgtacgaaaaccgtacgttacgggtacggccgtcggactacccgtatccgttatacccgttcacttcccgttccccgtcctacgttaccg

SEQ ID NO: 5141 - DNA, 510 bp, Homo sapiens
  misc_feature: GYAE6OF01BM52Y.8.28.C06.1.454.CMB.1.raw
  modified_base (310)..(310): a, c, t, g, unknown or other
  misc_feature (310)..(310): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (487)..(487): a, c, t, g, unknown or other
  misc_feature (487)..(487): n is a, c, g, or t
  modified_base (507)..(507): a, c, t, g, unknown or other
  misc_feature (507)..(507): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctgactcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccagtggaatcccagccaggttcagcggcagtgggtctgggacttgtcactctcaccatcaatacctgcaatctgacgtactttgctagtttatttctgtcagcagtctgaagactggtccgttcacgtttcggcggtagggaccagggtgacctanaacgatgngcgtgcacntctgtcttcatctcccgctntcg

SEQ ID NO: 5142 - DNA, 926 bp, Homo sapiens
  misc_feature: GYAE6OF01EHNDR.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagacgccaccctctcctgtgcggccagtcagagcgttaggacgtaacttagcctggtatcagcagaggcctggccaggcctcccgagacctcctctacttcgtttcgggccgtacccgtttaacgacgggtaccaggtcggaaacttccccgaggccccgtaagggtttccgaacggtccgggacgtacgggttcggggttccgtcgggggttaccgtttccggtttacgtaacccgttccgttacccgtaaccctaacgtttaacctaaaaccgttaaacccgtacgggtaacctaaaccgtttccgttaacgggtaacccgttaaccgtttttaccgtaccgttttaacggttttttaacgtttttaccgtttacggtttaccgtaacggttacccgtaacggtttaccgttaacgggtaaaccggttacggtttacccggggttaccccgttttaccggtttaacccgggtttttacccggggggaacccgggggttaaaccggggggtaaaccccgggtttaacggggggtaacccgggttaaccccggttaaaaccggtaaaaacccgggtaaccggtttaccgggtaaccgggggttaccggttaacccggtacccgttaaaccccgttaccggtttacccgttaccggttttaccccggttttcccttaaccggttttaccccccttttaccccgggtcctttaaccggtttaccccgg

SEQ ID NO: 5143 - DNA, 593 bp, Homo sapiens
  misc_feature: GYAE6OF01BY6X4.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagtcaccctctcctgtgcggcagtcagagcgttaggacgaacttagcctggtatcagcaggaggcctggccaggcctcccagacctcctcattctttggccgtcctttaacgacggggccaggtcggaactccccagccgtaggttccaggccggcaggtgggtctggggtaccttcggtcactctccaccatacaactaacctgactaatctcgtactacgtttgcttagttttacttctgtacagtctagtctagaagtacgtcggtccgttcgtacggtttcgggacgggtacgggaccgtaagggtacggacctaacgaaacgtacgtggtacggctcggaccaccgtcttcgttcgttcttaccacttccctccccgctagtccg

SEQ ID NO: 5144 - DNA, 533 bp, Homo sapiens
  misc_feature: GYAE6OF01EXH0Z.8.28.C06.1.454.CMB.1.raw
  modified_base (195)..(195): a, c, t, g, unknown or other
  misc_feature (195)..(195): n is a, c, g, or t
  modified_base (312)..(312): a, c, t, g, unknown or other
  misc_feature (312)..(312): n is a, c, g, or t
  modified_base (429)..(429): a, c, t, g, unknown or other
  misc_feature (429)..(429): n is a, c, g, or t
  modified_base (502)..(502): a, c, t, g, unknown or other
  misc_feature (502)..(502): n is a, c, g, or t
  modified_base (529)..(529): a, c, t, g, unknown or other
  misc_feature (529)..(529): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgtcctttaacgngggccagtggaatcccagccaggttcagcggcagtgggtctgggacttcgtcactctcaccatcaatacctgcaatctagacgtactttgctagtttattctgtcagcagtctgaanctggcttcgtacgtttcggcggtagggaccgaagggtcggacctacgaaacgactggtaggcgtcgacacctntccgtgtcttcacttccctccccgctntccg

SEQ ID NO: 5145 - DNA, 567 bp, Homo sapiens
  misc_feature: GYAE6OF01CA10A.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagagcgttaggacgaacttagcctggtatcagcagaggcctggccaggcctcccagacctcctcattctttggccgtacctttaacgaggggcccaggtcggaactccccagcccaggttcaggcggcaggtgggtctgggacttcgtcactctcacatcaaatacctgacaatctagacgtactttgacttagttttacttctagtctagtctagtctagaacgtacgtcgggtccttcgtaccgtttcgggacgggtacgggaccgaagggtcgacctacgaaacgtacgtgcggcgtcgacactgttctgttcctctacttcctcccgctgtccg

SEQ ID NO: 5146 - DNA, 573 bp, Homo sapiens
  misc_feature: GYAE6OF01BMB2B.8.28.C06.1.454.CMB.1.raw
  modified_base (200)..(200): a, c, t, g, unknown or other
  misc_feature (200)..(200): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggccgtacctttaacgacgggcccaggtggaactcccgagccaggttcaggcgcaggtgggtctgggtacttcgtcactctcacatcaatacctgacatctgacgtactttgctagtttattctgtctagtctagtctagaacgtacgtcggtaccgtttcctacgtttcgggcgggtaacgggtaccgaagggtcggacccgtacgaaaccgtacgtgtacggtcgtacgaccaccgtatcgttcgtcttactacttccttcccgcctcgttaccg

SEQ ID NO: 5147 - DNA, 657 bp, Homo sapiens
  misc_feature: GYAE6OF01AVTFR.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagcccaccctctcctgtcgcggccagtcagagcgttaggacgaacttgcctggtatcagcagaggcctggccaggcctcccgagacctcctcagtccgtttgggccgtacctttaacgcggggcctaggtcggaactcccgagcctaggttcaggcggctaggtgggtcgtgggtactttcgtcactctacacctatacaattaccctgactaatctagaaccgttattttgacttagttttacttcgtgtcctaagtctagttctaggaacgtccgtcgggtcctttcgtaaccgtttcgggacgggtaacgggtaccctaaagggttccggaaccttaacggaaaaccgtacggttcggtacgggtcctacggaccctaaccgtacgtttccggttacgtttaccctttaccgaaccgtttccccgttaccccgtccgtaacgttacccg

SEQ ID NO: 5148 - DNA, 572 bp, Homo sapiens
  misc_feature: GYAE6OF01BW17J.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtggtctgggacttcgtcactctcaccatcaataacctgacaatctagacgtactttgctagtttatttctgtcagcagtctgaagtactcggccgttcgtaccgttttcgggaccgggtaggggaccctaagggtcggtaccctacgaaaccgtaacgtggtcggtcgtcgacacctacttcgtcgttaccttctacttcccgtttaccccctagttcccgtaacgg

SEQ ID NO: 5149 - DNA, 1001 bp, Homo sapiens
  misc_feature: GYAE6OF01DHGPY.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgcccaccctctcctgtgcggccagtcagagcgttaggacgtaacttagcctaggtatcagcaaggacggcctgggcccagggcctaccccgagaccttccctctaacgtttcgtttcgggaccgttacccttttaaaacggcgggggtacccctaaggttacggggaaaccttcccccgaaggtccccgtaaggggttttacccaacggggcccgggtacgtaacggggtttcgggggggttacccgttacgggggggttaaccccttttttcccgggttttacccaaaccccggttttcccgtaaccccgtaaaaccccccgttaaagtttaaccccgtaaaaaaaccttttaaaacccccggttacggtaaacccttaaaaaccgtttttcccgttaaccggggtaaaaccccggttttaccggtttttttaacggggtaacctttttaaacgggtttttttaactttttcccgttaccggttttacccggtaaacgggttcccgttaaacgggtttacccgttaagggtaaaacggtttaaccccgggtttccgggggttaccccggttttaaccggttaacccgggtttttaccgggggaaccgggggttaaaccgggggtaacccggtaaacgggggttaccgggtaaccccgttaaccggtaaaaacccggttaacggttcgggtacgggtaccgtacggaccctaacccgtacgtttccgtttacggttacccttttacccgtaaccgttttcccccgtttaccccggtacccttacgttaacccgg

SEQ ID NO: 5150 - DNA, 607 bp, Homo sapiens
  misc_feature: GYAE6OF01DK3R7.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgtttttccngggganagagccaccctctcctgtgcggccagtcagagcgttaggacgaacttagcctggtatcagcagacggcctggccaggcctcccagactcctcattcgtttggcgtcctttaacgcgggccaggtggaactcccagcctaggtcaggcggcaggtgggtctgggacttcgtcactctacacatacaatacctgacatcagactatttgacttagttttattctgtacagtactagtctagaacgacgttcggtccgtttacgtacgtttcgggacgggtacgggaaccgtaagggtccgtacctaacgaaaaccggtacgtgggttacggaccgttacgacccgtaacctacgttaccgttcgttaccttacctaacgttcccctttaccccggccttacgttaccgg

SEQ ID NO: 5151 - DNA, 571 bp, Homo sapiens
  misc_feature: GYAE6OF01C5TV5.8.28.C06.1.454.CMB.1.raw
  modified_base (195)..(195): a, c, t, g, unknown or other
  misc_feature (195)..(195): n is a, c, g, or t
  modified_base (202)..(202): a, c, t, g, unknown or other
  misc_feature (202)..(202): n is a, c, g, or t
  modified_base (565)..(565): a, c, t, g, unknown or other
  misc_feature (565)..(565): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggganagagccaccctctcctgtgcggccagtcagagcgttaggacgaacttagcctggtatcagcagaggcctggccaggctcccagactcctcattctttggcgtcctttaacgacgggtccaggtggaactccccagccaggttcagcggcaggtgggtctggggacttcgttcactctcaccatacaaataacctgacaatctagtacgtactttgcttagtttactttcgtcgttcagtctagtctaggaacgtacgtcggtccgtttctaccggtttcgggacgggtacgggaccgtaagggtcgacctacgaaacgtaactggtcggcgtcgaccactatcgtgtcttcacttccttcccnctgtcg

SEQ ID NO: 5152 - DNA, 595 bp, Homo sapiens
  misc_feature: GYAE6OF01CSKL1.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgtttttccgnggggagagagccaccctctcctgtgccggccagtcagagtcgttaggacgtaacttgcctggtatcagcagacggcctggccaggcctcccgagacctcctcattcgtttggccgtacctttaacgcgggccaggtcggaactcccgagccgtaggtcaggcggctaggtcgggtctgggtactttcgtacactctacacctatacctaactacctgactaactctacgtacgtactttgacttagttttacttcgtgtcagtctagtcgtagaacgtctcgggtccgttacgtacggtttcggacgggtacgggacgtaacgggtacgacctaacgaaacggtacgtgtcggtctcgacacgtattccgtagttcttctacttccttcccgctcgtacg

SEQ ID NO: 5153 - DNA, 558 bp, Homo sapiens
  misc_feature: GYAE6OF01BX70E.8.28.C06.1.454.CMB.1.raw
  modified_base (292)..(292): a, c, t, g, unknown or other
  misc_feature (292)..(292): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagataccaccggagagattgtgttgacacagtctccagccaccctgtctttgtctccagggggaaagagccaccctctcctgcagggccagtcagagtcgttaccaccagttagcctggtaccaacacaaacctggccaggctcccaggcccctnatcttgatgcatccatcagggccatggcactcccagccaggttcagtggcaggtgggtctggggacagacttcactctcaccatcagcagcctagacgcctagaagtatttgcttagtttattactgttacaactatcgtaaccgagtcggccgtccggggcctacggtttccgggacccgttagggaaccctaaagttgaacgtatacgaaacgacgttgtcggtctagccaccatcgttcgtcttacacttcccttcccgtacc

SEQ ID NO: 5154 - DNA, 551 bp, Homo sapiens
  misc_feature: GYAE6OF01CTMM4.8.28.C06.1.454.CMB.1.raw
  modified_base (259)..(259): a, c, t, g, unknown or other
  misc_feature (259)..(259): n is a, c, g, or t
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgtggggagagagccaccctctcctgtgcggccagtcagagcgttaggacgaacttagcctggtancagcagaggcctggccaggctcccagacctcctcatcgtttcggccgtcctttaacgacgggcctaggtgaactcccagccaggtcagcggcaggtgggtctgggacttcgtcactctcacctatcaataccngcaatcngactacttgcttagtttattctgtcagtctagtctagaacgtctgggtccttacgacgtttcggacgggtacggaccgaggtcggacctacgaaacgtacgtggtcgcgtcgaccactactcgtcgttcttacacttccctcccgctagtcg

SEQ ID NO: 5155 - DNA, 520 bp, Homo sapiens
  misc_feature: GYAE6OF01A7ZA0.8.28.C06.1.454.CMB.1.raw
  modified_base (201)..(201): a, c, t, g, unknown or other
  misc_feature (201)..(201): n is a, c, g, or t
  modified_base (497)..(497): a, c, t, g, unknown or other
  misc_feature (497)..(497): n is a, c, g, or t
  modified_base (514)..(514): a, c, t, g, unknown or other
  misc_feature (514)..(514): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgtcctttaacgagggccaggtcggaatccccagccaggttcagcggcaggtgggtctgggacttcgtcactctcacatcaatacctgacaatctagacgtactttgctagtttattctgtcagtctagtctgaagctggtccgttcacgtttcggcggtaggaccaggtcgacctacaacgtacgtgtgctcgcacntctgtcttcatcctccnctgtcg

SEQ ID NO: 5156 - DNA, 767 bp, Homo sapiens
  misc_feature: GYAE6OF01D969Z.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccaccctctcctgtcgcggccagtcagagtcggttaggacgaacttagcctggtatcagcagacggcctaggccaggcctccgagacctcctctagttcgtttcggcctacctttaacgcggggtaccaggtcggaactaccccgagtaccgaggttcgacggccggcgtagggttcgggtccgtaggggtacctttccggttaccaccgttctaccaaccctacgtaactaaacttaacccgtgaacctaacttccgtacgtaaccgtttactttacggtacgtttacgttttaacgtttctacggttactacgtaccgtaggttactacggtaacggtaccgtttaccgggtcccgtttaccgttaaccgggtttccggggaaccgggggtaaccggggtaacccgtaacgggggttaccgtaacccgtaacgtaaaaccggtaacggttacgggttacggtaccgttaccggacccgtaacccgttcgttaccccgtttacgtttaccctttacgacccttttacccccgttaccccgtcccgttaacttacccgg

SEQ ID NO: 5157 - DNA, 619 bp, Homo sapiens
  misc_feature: GYAE6OF01BSOWM.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgtcttgtttttccnggggagagagccaccctctcctgtgcggccagtcagagcgttaggacaacttagcctggtatcagcagaggcctggccaggcctccagacctcctcattcgtttggccgtacctttaacgagggtccaggtggaactcccagccgtaggttcaggcggcgaggtgggtcgtgggtacttcgtcactctcaccatacaactacctgactaatctagaccgtactttgacttagttttatttctgtactagtactagtactagaacgtacgtcgtccgttacgtacggtttccgggacggggtaacgggtaaccggtaagggtacggtacccgtaacgaaaccggtacgtaggtcggtcgtcgtacctacctacgttcctacgttccttacgttacttccccgttccccgtcctacgttaccgg

SEQ ID NO: 5158 - DNA, 521 bp, Homo sapiens
  misc_feature: GYAE6OF01D1Z16.8.28.C06.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
  modified_base (393)..(393): a, c, t, g, unknown or other
  misc_feature (393)..(393): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctttgtctccaggggaaanagccaccctctcctgcagggccagtcagaatgttggcgccttcgtaagctggtaccaacacaaacctggccaggctcccaggcccctcatctatggtgcatccaacngggccactggcatcccagccaggttcagtgcagtggtatggacagacttcactctcacatcatcagcctggacgctagaagtntgttgctagtttattactgtacaactatacgtaccgagtcggccgtccggggcctacgttccgccgtggaccgaggtggagactacgaacgtactggtcggctcgcactatctagttctctcttcccg

SEQ ID NO: 5159 - DNA, 589 bp, Homo sapiens
  misc_feature: GYAE6OF01B2B7N.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtgaatcccagccaggtcagcggcagtgggtctgggacttcgtcactctcaccatcaatacctgcaatctgacgactttgactagtttattctgtcagtcagtctagaacgtactgggtcccgtttcgtaacgtttcgggaccgggtacggggtaacccaaggggttcggaacccgtacgaaaaccggtaacgttcggtacgggccgtcggaccctaacccgtagttcccttggttccctttaccgactttcccgttccccgcctagttcccg

SEQ ID NO: 5160 - DNA, 579 bp, Homo sapiens
  misc_feature: GYAE6OF01C9P2T.8.28.C06.1.454.CMB.1.raw
  modified_base (195)..(195): a, c, t, g, unknown or other
  misc_feature (195)..(195): n is a, c, g, or t
  modified_base (260)..(260): a, c, t, g, unknown or other
  misc_feature (260)..(260): n is a, c, g, or t
  modified_base (365)..(365): a, c, t, g, unknown or other
  misc_feature (365)..(365): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgccggccagtcagagcgttaaggacgaacttagcctggtancagcagaggcctggccaggctcccagactcctcatcgtttggcgtcctttaacgagggccagtggactcccagccaggtcagcgcagtgggtctgggacttcgtnactctcacctatacaataccctgcaatctagacgtactttgctagtttactttctgtcagtcagtctagaagcgtggtccttcgtacgttcgggacggtacgggaccgaagggtacgtaccctaacgaaaccggtacgtggtcggcgtcgcctaaccgacttccgttacgttacctttccaactttccccgtttccccgccttacgttacccgg

SEQ ID NO: 5161 - DNA, 569 bp, Homo sapiens
  misc_feature: GYAE6OF01D903R.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacgaacttagcctggtatcagcaggacggcctggccaggcctcccagacctcctcattctttcggccgtcctttaacgagggccaggtggaactccagccgaggttcaggcggcaggtcgggtctgggtacttcgtcactctcacatcaatacctgactatctagacgtactttgactagtttatttctgtcagtctagtcgtagaacgtactcggtccgttcgtacgtttcgggacgggtaacgggtaccgaagggtcgacctacgaaacgtacgtggtaggtctcgacactcgtctgtccttcacttcccttacccgctagtaccg

SEQ ID NO: 5162 - DNA, 636 bp, Homo sapiens
  misc_feature: GYAE6OF01C3Y8R.8.28.C06.1.454.CMB.1.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
  modified_base (388)..(388): a, c, t, g, unknown or other
  misc_feature (388)..(388): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (613)..(613): a, c, t, g, unknown or other
  misc_feature (613)..(613): n is a, c, g, or t
  modified_base (630)..(630): a, c, t, g, unknown or other
  misc_feature (630)..(630): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcacctgtcttgttttcgngggangagccacctctcctgtcgcggaccagtcagagcggttaggacgtaacttagcctggtancagcaggtacggccnggccaggtcctcccgaagtcctcctatacgttcgttttcggccgttacctttaaacgcggggccaaggttacggaacctccccgaaggtcccgtaagggttccacgggcggtacgnggttcggggtcgtaggggtcctttcggtctacctcgtacaccattaacaacgtaacctgactaatcaggtactattgactttagtttntcgttnacgtagtcagtctaagaacgtcgttcgtccgtttacgtaccggtttcgggacgggtacggaacgtacgggtacgtacctaaccgaaaagtccgtggtacgcgtcacctacgtacttcgttaccttcttacnccgtttcccttccccgntgtacg

SEQ ID NO: 5163 - DNA, 647 bp, Homo sapiens
  misc_feature: GYAE6OF01DMDWF.8.28.C06.1.454.CMB.1.raw
  modified_base (194)..(194): a, c, t, g, unknown or other
  misc_feature (194)..(194): n is a, c, g, or t
  modified_base (263)..(263): a, c, t, g, unknown or other
  misc_feature (263)..(263): n is a, c, g, or t
  modified_base (315)..(315): a, c, t, g, unknown or other
  misc_feature (315)..(315): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgtttttccnggggagagagccacctctcctgtgcgccagtcagagcgttaggacgtaacttagcctggtatcagcagnggcctggccaggctcccagacctcctcacttctttggccgtacctttaacgngggcccaggtggaactcccgaagccaggttcagcggcaggtgggtactgggacttcgtcacgtctacaccatacaatacctgaccaatctagacgtactttgactagtttattcgtgtcagtcagtctaggaacgtacgtggtacctttccgtacgttttaccgggcggggtaaccgggaaccggtaaagggttccggaaacccgtaaccgtaaaacggtaaaccgttcgggtaacggtccgtacggaccgtaaacccggtactttcccgttaggtttaccctttaccgtaccttaccccgttttcccccgaccgttaacggtaaccccggg

SEQ ID NO: 5164 - DNA, 786 bp, Homo sapiens
  misc_feature: GYAE6OF01C8SDP.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtcctccggtcaccctgtcttgtttttccgnggggagagagcccaccctctcctgtgcggccagtcagagcgttaggactaacttagcctggtactcgagcaggacggcctggccagggcctcccgacgacctcctctacttcgtttcggccgtacctttaaacgcgggtccaggttcggaaactcccgagcccgtaggttcgacggcggcgaggttcgggtcgttcggggtactttcggttccacgttcctacaccgtataaccgtaaacttaacccgtcgaacctaacgtacgtacgtaaccggttaccgttttcggtaccgtttaaggttttaacctttcgttacggttaccgtaacggttaccgtaacggtttaccgttaacgggtaaaccggttacggttaccgggttacccggtttaccgttaccgggtttttacccgggggaccggggttaaaccggggtaaccccggtaaaggggttaccggtaaacccgtaaccgggtaaaaccggtacggttacggtaccgggtaccgtaccgggtaccaacccggttacgttccgttacggtttcccttacgtaccttccccgtttccccggtacctacgttacccgg

SEQ ID NO: 5165 - DNA, 653 bp, Homo sapiens
  misc_feature: GYAE6OF01BFSTA.8.28.C06.1.454.CMB.1.raw
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggganagagcccaccctctcctgtgcggccagtcagagcgttaggacgaacttgcctggtatcagcagaggcctggccaggcctcccagacctcctcattcctttggcgtacccgtttaacgacggggccaggtcgggaactccccgaggccccgaggttccgacggccgggacgtagggtcggggttcgtacgggggtacctttcgtttaccgaaccgttccttaccacccgtatacaaaacttaaccctgacctaatctacggactacgtttgcttaagttttatttctgttacagtctagtcgtagaacgtacgtcgggtccgttcctaacggtttccgggacgggtacgggtaccgtaagggtcggaccctaacgaaacggtactggtacggccgtggtaccacctagttcgttcgtttctttactcccgttacccgcctagtccgtacgg

SEQ ID NO: 5166 - DNA, 518 bp, Homo sapiens
  misc_feature: GYAE6OF01DP119.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (419)..(419): a, c, t, g, unknown or other
  misc_feature (419)..(419): n is a, c, g, or t
  modified_base (478)..(478): a, c, t, g, unknown or other
  misc_feature (478)..(478): n is a, c, g, or t
  modified_base (497)..(497): a, c, t, g, unknown or other
  misc_feature (497)..(497): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgcctttaacgagggcccaggtggaactccccagccaggttacagcggcagtgggtctgggacttcgtcactctcaccatcaataacctgcaatctgactactttgctagtttatttctntcagtcagtctagaagactggccttcacgtttcggcggtacgggacaaggtcgacctanaaacgactgtggctgcacntctgtcttcatccncnctntc

SEQ ID NO: 5167 - DNA, 653 bp, Homo sapiens
  misc_feature: GYAE6OF01BDR3O.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggcctcccagacctcctcatctttggcgtcctttaacaggggccaggtcggaactccccagcccaggttcaggccggcaggtggggtctcgggtacttcgttcactctccacctatcaactaacctgacaatctcgacgtactttgactagttttactttctcgtcacgtcaagttctaggaacgtacgttcgggtccgtttctaccggttttccggggacgggtaacggggtacccgtaaacggggttccggaacccgttacgtaaaaccggtaaccgttcgggtagggtcccgttacggacccgtaaccctacgttccgttacggttccctttacctaaccgtttcccgtttaccccccgtaccgtacttacccgg

SEQ ID NO: 5168 - DNA, 633 bp, Homo sapiens
  misc_feature: GYAE6OF01D6DUR.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagagccaccctctcctgtgcggccagtcagagcgttaggacgaacttagcctggtatcagcagacggcctggccaggcctacccagacctcctctacttcgtttggccgtacctttaacgacggggccaggtcggaactccccgagcctaggttcaggcggcaggtgggtctgggtactttcgtcacgtctacaccatacaatacctgactaatctagacgtactttgcttagttttactttctgtctacgtctagttcgtaggaagtccgttgggtcccgttaccttacggtttaccgggcggggtaacgggtaaccgtaaggggtcgacccgttaaccgaaaacgtacgttggtcggcctacggaccctaaccgtcttccgttcgttacctttaccgtacccttcccgttaccccgtcctaagttccg

SEQ ID NO: 5169 - DNA, 711 bp, Homo sapiens
  misc_feature: GYAE6OF01A1FDN.8.28.C06.1.454.CMB.1.raw
  modified_base (142)..(142): a, c, t, g, unknown or other
  misc_feature (142)..(142): n is a, c, g, or t
  modified_base (199)..(199): a, c, t, g, unknown or other
  misc_feature (199)..(199): n is a, c, g, or t
  modified_base (272)..(272): a, c, t, g, unknown or other
  misc_feature (272)..(272): n is a, c, g, or t
tcagctcgcgtgtccacgaccggtgctcgatttagagctcacgtattgggtttgggggtagggtaacgtggcgtcagttaggacccagacggaaccataggaagcccagcgcagctctcttcctcctgctactctgctccanagatcattggagaagtggtgatgacacagtctccggtcaccctgtcttgtttttccnggggtacgagacgcctaaccctctcctgtcgcggccagtcaggaagcggttaaggactaacttgccttggtancagtcaggacggcctagggccacgggcctacccgacgaccgtccctacgactttccgtttgggcccgttacccgtttaaaccgacgggggaccctaaggtcgggaacttccccgacgtaccgaacgggtttcaggtccggaccgtaggtacggggttctacggggtacctttcgggtacctaccgtttcgacctaaccgtactttccgaaaaccttaaaccgtcgactaactcgtacgtacgtacgttacgtctaagtttacttacttgttctacgtactacgtcgtagtaacgtacgttcggtacgtccgtacgtttccggacggttacgggactaacgggtaccgtacgtaaccgtaaacggtaacgtacggtaggtacgtccgacctacggtactcgttactcgttacgacctttccgtcccgtcccgtgttaccg

SEQ ID NO: 5170 - DNA, 599 bp, Homo sapiens
  misc_feature: GYAE6OF01B4RLA.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagagccaccctctcctgtgcggccagtcagagcgttaggacgaacttagcctggtatcagcagaggcctggccaggcctcccagacctcctcattctttggccgtcccttttaaacgaggggcccaggtcgggaaacttccccgaaggccctagggttcaggtcgggacaggtgggtctggggtaccttcgttcacgtctcaccatcaaatacctgacaatctagacgtactttgctagtttactttctgtcagtctagtctagtaagtacgtcggtccgtttcgtacgttttcgggacgggtacgggaccgtaagggtcggtacctacgaaacgtacgtcggtacggcgtcgacacctagtcttcggtactttccacttcccttcccgcctgttaccg

SEQ ID NO: 5171 - DNA, 607 bp, Homo sapiens
  misc_feature: GYAE6OF01BSI2B.8.28.C06.1.454.CMB.1.raw
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcgtttggccgtcctttaacgagggcccaggtggtaactccccagcccaggttcagcggcaggtgggtctgggacttcgtcactctcaccntcaataccnacatctgacgtacttgctagtttatttctgtcagtcagttcctagaacgtacgtcgggtccgtttcgtaccgtttccgggacggggtaacgggtaaccgtaacggggttcggaacccgtaacgaaaaccgtaacgttacggtgggtaccgtcggtacccaccgtagttcccttcgtttaccttactaccttcccgtttccccgccctagttcccg

SEQ ID NO: 5172 - DNA, 543 bp, Homo sapiens
  misc_feature: GYAE6OF01BHMWI.8.28.C06.1.454.CMB.1.raw
  modified_base (514)..(514): a, c, t, g, unknown or other
  misc_feature (514)..(514): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggcgtacctttaacgacgggccagtggaactcccagccaggttcagcggcagtggtctgggacttcgtcactctcaccatcaatacctgacaatctgacgtactttgctagtttattctgtcagtcagtctgaagtcgtcggtccgttcacgtttcgggacggtacgggaccaagggtcgacctacgaaacgtacgtggtcggcgtcgccaccgtntctgttcctcacttcctcccgcctgtccg

SEQ ID NO: 5173 - DNA, 542 bp, Homo sapiens
  misc_feature: GYAE6OF01C7BWB.8.28.C06.1.454.CMB.1.raw
  modified_base (301)..(301): a, c, t, g, unknown or other
  misc_feature (301)..(301): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctatggtncatccaacagggccactggcactcccagccaggttcagtgcagtgggtatgggacagcttcactctcaccatcatcagcctgggacgccgtagaagagttgttgtcgtagtttattacttgtactaactacgtcgtaccgagtcgggtcccgtccggggccctaccgttccggcccgtcgggtaccgaggtcggagacgtacgaaacggtaactggtaggcgtgaccactactcgtgttcc

SEQ ID NO: 5174 - DNA, 615 bp, Homo sapiens
  misc_feature: GYAE6OF01BS0N7.8.28.C06.1.454.CMB.1.raw
  modified_base (377)..(377): a, c, t, g, unknown or other
  misc_feature (377)..(377): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagccaccctctcctgtgcggccagtcagagcgttaggacgaacttagcctggtatcagcagaggcctggccaggctcccagactcctcatcgtttggcgtcctttaacgagggccaggtcggaactcccagcctaggttcaggcggcaggtggtcgtgggacttcgtcactcncacatcaataactgactaatctagacgtactttgcttagtttacttctgtctagctaagtctaggaagtccgttacgggtcccgtttacgtaccggttttccggggaccggggtaacggggtaacccgtaaggggttaccgggaaccctaaccgtaaaacggtaccgttgggtacgggtcgtacgacctaccctaagttcctcgttcttaccacttcccgttcccgcctacgtaccgg

SEQ ID NO: 5175 - DNA, 573 bp, Homo sapiens
  misc_feature: GYAE6OF01AHJ0H.8.28.C06.1.454.CMB.1.raw
  modified_base (537)..(537): a, c, t, g, unknown or other
  misc_feature (537)..(537): n is a, c, g, or t
  modified_base (568)..(568): a, c, t, g, unknown or other
  misc_feature (568)..(568): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagcccaccctctcctgtgcggccagtcagagcgttaggacgaacttagcctggtatcagcagaggcctggccaggctcccagactcctcatctttggcgcctttaacagggccaggtggaactcccagccaggttcagcggcaggtgggtctggggacttcgtcactctcaccatcaataacctgacaatctgacgtactttcgctagttttattctgtcagtctagttctaggtaagacgtcgggtacccgtttcgtaaccgttttcgggccgggtaagggtacccaagggttcggacctacgaaacgtactggtacggcgtcgaccaccgnttcctgttccttacacttcccttcccgcctntaccg

SEQ ID NO: 5176 - DNA, 662 bp, Homo sapiens
  misc_feature: GYAE6OF01DHSVT.8.28.C06.1.454.CMB.1.raw
  modified_base (200)..(200): a, c, t, g, unknown or other
  misc_feature (200)..(200): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgccggccagtcagacgtcgttaggacgaacttagcctggtatcagcagaggcctggccaggctccagtactcctcattcgttttcggcgtcctttaacgagggccaggtacggaactccccgagtaccgaggttacaggcggacgtaggtcgggtcgtgggtacctttcgttcaccgtctcgacctatactaaactaccgtgactaactcgtacgtaaccgttacgtttacgactttagttttaactttctcgttacgtagtaccgtagttcgtaggtaacgtaccgttcggtcccgtttacgtaccggtttcgggaccggggtacgggaaccggtaacgggtaccggtaccgtaacgaaaccggtaacgtggttacggccgtacgacctacccgtactttcgtcgttacgttcctaacttcccgttacccgtcctacgtaccg

SEQ ID NO: 5177 - DNA, 777 bp, Homo sapiens
  misc_feature: GYAE6OF01BCHLN.8.28.C06.1.454.CMB.1.raw
  modified_base (201)..(201): a, c, t, g, unknown or other
  misc_feature (201)..(201): n is a, c, g, or t
  modified_base (258)..(258): a, c, t, g, unknown or other
  misc_feature (258)..(258): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagcccacctctcctgtgcggccagtcagagcgttaggacgaacttagcctggtancagcagaggcctggccaggcctccgagtacctcctctagttccgttttcgggccgttacccgtttaaacgacggggtaccctaggttacgggaaaccttccccgaagtccccgtaaagggtttccaagggccgggtccgaagggtttcggggtccgttacgggggtaacctttcgggttaccacttcctaccacctaatacctaaacttaaaccctgaacctaacgttcctacggtaaccgttacgttttacggaccctttaaaggttttttaactttcccgttagttaccgtaacggttccgtaacggtttacccgtaaggtaaacggttaaccgtttcgggggttaccccgttttacgtaacccgggtttttccgggggaaccggggttaacggggtaaaccggtaacggggtttaccggaacccgttacgaaaaccgggtaacgtcgggtaacggtcgtacggacctaccgtagttccgtgttaccttcgtacttcccttacccgcctcgttaccg

SEQ ID NO: 5178 - DNA, 659 bp, Homo sapiens
  misc_feature: GYAE6OF01B7AK8.8.28.C06.1.454.CMB.1.raw
  modified_base (193)..(193): a, c, t, g, unknown or other
  misc_feature (193)..(193): n is a, c, g, or t
  modified_base (254)..(254): a, c, t, g, unknown or other
  misc_feature (254)..(254): n is a, c, g, or t
  modified_base (626)..(626): a, c, t, g, unknown or other
  misc_feature (626)..(626): n is a, c, g, or t
tcagctcgcgtgtccacgaccggtgctcgatttagagctcacgtattgggtttggggaggaactgctcagttaggacccagacggaaccatggaagcccagcgcagcttctcttcctcctgctactctggctccagagatcattggagaagtggtgatgacacagtctccggtcaccctgtctgtttttccgnggggagagagcccaccctctcctgtgcggccagtcagagcgttaggacaattagctggtancagcaggaggcgtggccgaggcctaccagacctcctcgtattcgtttggccgtacctttaacgacgggtaccaggttcggaaacttccccgaaggtcccgtaagggttccgaacggccgggtacgtagggttcgggggtccgttacggggggtaacctttccggtttcctacgttccttaccaaccctaattaaccgaaacttaacccgtgaacctaacgttactacgtacggttacctttagtacttaagttttactttacgtcgtactacgtcgtagtcgtaagacgtacgtcggtccgttcgtacgttcgggacgggtaacgggacgtaaggtcgtaacctacgaacggacttggcggctcgacacgtntccgtgttccttacacttcctcccgctcgtacg

SEQ ID NO: 5179 - DNA, 599 bp, Homo sapiens
  misc_feature: GYAE6OF01DYPME.8.28.C06.1.454.CMB.1.raw
  modified_base (201)..(201): a, c, t, g, unknown or other
  misc_feature (201)..(201): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (472)..(472): a, c, t, g, unknown or other
  misc_feature (472)..(472): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcattctttggccgttacctttaacgacggggcccaggtcggaactccccgaagtcccgaggttcaggcggacgaggtgggtctgggtacttcgtcactcncaccntacaatacctgacatctgactacttgtacttagtttactttctgtcagtctagtctagaagtacgtcggtcccgttntaccgtttcggacgggtaacggaccgtaagggtcgacctacgaaaacgtacgtcggtacggtcgtacgcctaccgcttaccgttgttacccttactaaccttcccgtttaccccgcctaacgttccg

SEQ ID NO: 5180 - DNA, 951 bp, Homo sapiens
  misc_feature: GYAE6OF01AB3PW.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagacgatcagttggagaagtggtgatgacacagtctccggtcaccctgtctgttttccnggggangagccaccgtntcctgtgcgccagtccagacgcggttagacgtaacttcgacctggtatcgagtcaggacggcctggaccaggcctacccgaggaccttcctactacgttccgttttcgggacctaccgttttaaaaccgcgggggtaccctaagggtttacgggaaacccttccccggacggtacccccgttaacggggtttccgaacgggtacccgggtccggtaaacgggtttccggggggttaccgtttacggggggaacccgtttttccgggtttactaacccgttccggttaacccgtaaacccgttaaacttaaccgtaaaaccgttaaacccgtcgggtaacctaaacgttccgttaacggtaaccgttaaccggtttttacggaaccgtttaacggtttttaaccgtttacgttaccgggttaccgtaacggtaccgtaacgggtttaccgtaaggtaacggttacccgggtttaccgggtaccccgtttttacccgtaacccgggtttttaaccgggggacccgggggttaaacccggggtaacccgggttaaaccggggttacccgggtaaaccccgtttaaaccgggtaaaaacccggtaacccggtttaccgggtaccgggttaaccccgttccggtaaccccgtaacccgtaccgtttacccgttaaccggtttacccgtttaacgttaccccgtttacccgttacccccggttaccgtaaccgtttaacccggg

SEQ ID NO: 5181 - DNA, 545 bp, Homo sapiens
  misc_feature: GYAE6OF01AR9AK.8.28.C06.1.454.CMB.1.raw
  modified_base (311)..(311): a, c, t, g, unknown or other
  misc_feature (311)..(311): n is a, c, g, or t
  modified_base (514)..(514): a, c, t, g, unknown or other
  misc_feature (514)..(514): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacaacttagcctggtatcagcagacggcctggccaggctcccagacctcctcatctttggctcctttaacngggccagtggaactcccagccaggtcagcggcagtgggtctgggacttcgtcactctcacatcaatacctgcaatctagacgtactttgctagtttattctgtcagtcagtctagaacgctcgggtcgttactacgttcgggacgggtacgggacctaagggtcgacctacgaaacgaacgtcgtggctcgcctactctcgtntaccttcacttaccttccccgctacgttccg

SEQ ID NO: 5182 - DNA, 618 bp, Homo sapiens
  misc_feature: GYAE6OF01DUEZ0.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgtcctttaacagggccagtggaactcccagccaggttcagcggcaggtgggtctgggacttcgtcactctcaccatacaactaacctgacaatctagacgtactttgctagtttattctgtcagtcagtctagaagactcgggtccgttctacgtttccgggcgggtacgggtaacccgtaacgggttcgggaacccttaacgaaaacccggtaacgttcggtaggggtaccttcggaccctaacccgtacgttcccgttggttaccctttaccgtacgtttacccctttccccccgggacccttaacgtttacccgg

SEQ ID NO: 5183 - DNA, 542 bp, Homo sapiens
  misc_feature: GYAE6OF01BOOBG.8.28.C06.1.454.CMB.1.raw
  modified_base (536)..(536): a, c, t, g, unknown or other
  misc_feature (536)..(536): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccgagccaggttcagcggcagtgggtctgggacttcgttcactctcaccatcaatactgacaatctagactatttgctagttttattctgtcagctagtctgaagctcggctttcacgtttcgggacggtacgggaccagggttcggaccctacgaaaccgtagtcgtggacgtgaccacctatcctgttcttcactttcccgtcccgcctnttaccg

SEQ ID NO: 5184 - DNA, 605 bp, Homo sapiens
  misc_feature: GYAE6OF01BLELU.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctccctcattctttgggccgtccttttaacgaggggccaggtggaactcccagccaggttcaggcggcaggtgggtctgggtacttcgtcactctcacatcaatacctgacaatctgacgtactttgcttagttttacttctgtcagtcgtagttcgtagaacgtcgtcggtcccgttcgttaccggtttcgggacgggtaacggggtaccgtaacgggtcggtaccctaacgaaaccggtacgtgggtcggtcgtcggacccaccgtcttccgttcgttacctttccacgtttcccttccccggtcctagttacccg

SEQ ID NO: 5185 - DNA, 623 bp, Homo sapiens
  misc_feature: GYAE6OF01DRWKN.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacaacttagcctggtatcagcagaggcctggccaggctcccacggcccctcatctatggtgcatccaacgcgggccacgtgcatcccagcctaggttcaggtggcaggtggtagtgggacagtactcactctcaccatcatcacgccgtggacgccgtgaaggtattcggttgtacgttagttttacttacgtcgttacaactattaccggtaaccgtaggtcggtcccggttcccgggggtacccttaaccggtttccgggccccgttaggggtaaaccctaaaagggtcggtaaacttaacgtaaaccgtaaaaccggtaacgttcggtacgggtacgtacggacctaacccgtagtttaccgttcggttacctttacccg

SEQ ID NO: 5186 - DNA, 572 bp, Homo sapiens
  misc_feature: GYAE6OF01D7LR8.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctccagactcctcatctttggcgtacctttaacgagggccagtggactcccagccaggttcagcggcagtgggtctgggacttcgtcactctcaccatcaatacctgacaatctgacgtactttgcttagtttacttctgtcagtctagtctagaagtctcggtccgttcgtacgtttcgggcgggtacgggaccgtaagggtcggaccctacgaaaccgtaagtcggtggacgtcgacctaccgtcttccgttgttccttttacgtcctttaccccgaccttacgtccgtacgg

SEQ ID NO: 5187 - DNA, 520 bp, Homo sapiens
  misc_feature: GYAE6OF01A39MZ.8.28.C06.1.454.CMB.1.raw
  modified_base (497)..(497): a, c, t, g, unknown or other
  misc_feature (497)..(497): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgggtgcggccagtcagagcgttaggacgaacttagcctggtatcagcagaggcctggccaggctcccagactcctcatctttggcgcctttaacagggccagtggaactcccagccaggttcagcggcagtgggtctgggacttcgtcactctcaccatcaatacctgcaatctgacgactttgctagtttattctgtcagctagtctagaagtactggccgttcacgtttcgggcggtagggacctaagggtcgacctcgaaacgactggtgctgcacntctgtctcactcctccgctatcg

SEQ ID NO: 5188 - DNA, 733 bp, Homo sapiens
  misc_feature: GYAE6OF01C7HEW.8.28.C06.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctccagagatcattggagaagtggtgatgacacagtctccggtcacctgtcttgttttccgnggggagagacgcctaccctctcctggtgcggccagtcagngcgttaaggactaacttagcctggtactcgagcagaggccgtaggccgacggtcctacccgagaccctcctctacttcgtttcggaccgtacctttaacgacgggtcccaggtacggaacctcccgacgccgtaacggttcgacggcggtcgtagggttcggggttacgttacggggtacctttccggttacgtaccttcctacccaacctaactacctaaacgttaacctgtacctaacgttcctaggaacccgtttacttttacgtacgtttaagttttacgtttacgttcgtacgagtaccgtagtacgtacggaacgtacgttccggtacccgtttccgtacggtttccgggaacggggtaacgggtaccggtaagggttaccggaacctaacggaaaccgtacggttcggtcggtacgtccggtacctaacccgtgttccggttacttaccgttaaccgttccttacccgttcccctccgtacgttaccggg

SEQ ID NO: 5189 - DNA, 564 bp, Homo sapiens
  misc_feature: GYAE6OF01ENA3E.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggcgtcctttaacgagggccagtggaatcccagccaggttcagcgcaggtggtctgggacttcgtcactctcaccatcaataacctgactaatctgacgtactttgctagtttatttctgtcagtctagtctagaacgtacttcggtccgttcgtacgtttcgggacgggtacgggaccgtaagggtcggaacccgtacgaaaaccgtaacgtggtcggtctcgacaccattcgtgttccttctacttaccttccccgctacttccg

SEQ ID NO: 5190 - DNA, 635 bp, Homo sapiens
  misc_feature: GYAE6OF01A9XU0.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccngggganagacgccaccctctcctgtgcggccagtcagagcgttaggacgaacttagcctggtatcagcaagaggcctggccaggcctcccagacctcctctattctttggccgtccgtttaaacgacgggccaaggttcggaactccccgagtaccgtaggttcaggtcgggacgtaggtcgggttcgtggggtacctttcggttccaacgttctaccgacctatacaaacttaaccgtgacaatctacgtacgtacgtttagtctaagtttattctgtactacgtactacgtctaggacgtacgtacgtccgttcgtaacgtttcggacgggacggttaaccgaggttacggacctacgtaaacgtacgtcggtacggtcgtccgtacaccgtaacgtccttacgttcttaccgtacttaccgtccccgtctacgtaccg

SEQ ID NO: 5191 - DNA, 546 bp, Homo sapiens
  misc_feature: GYAE6OF01EN3GR.8.28.C06.1.454.CMB.1.raw
  modified_base (194)..(194): a, c, t, g, unknown or other
  misc_feature (194)..(194): n is a, c, g, or t
  modified_base (543)..(543): a, c, t, g, unknown or other
  misc_feature (543)..(543): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgcctttaacgagggccagtggaactcccagccaggttcagtcggcaggtggtcgtgggacttcgtcactctcaccatacaataaccctgacctaatctagtacgtactttgactagtttatttctgttcagtctagtctagaagtacgtggtccgttcgtacgtttcgggcgggtaggaccgaacggtggaccgtacgaaacgactggtgcgtcgcacactctactctctactccttccgtctntcg

SEQ ID NO: 5192 - DNA, 675 bp, Homo sapiens
  misc_feature: GYAE6OF01BWZSH.8.28.C06.1.454.CMB.1.raw
  modified_base (205)..(205): a, c, t, g, unknown or other
  misc_feature (205)..(205): n is a, c, g, or t
  modified_base (627)..(627): a, c, t, g, unknown or other
  misc_feature (627)..(627): n is a, c, g, or t
tcagctcgcgtgtccacgaccggtgctcgatttagagctcacgtattggggtttgggggaggaaatgctcaggttagggacccagacggaaccatggaagccccagcggcagcttctcttcctcctgcctactctggctcccagagatcattggagaagtggtgatgacacgagtcgtcccggtcaccctgtcttcgtttttccnggggacacgacgcccgacccctctcccgtgttccgcgggcccacgtcagacgcggttaaggaccgaaaccttaggcctaggtactccgaaggccacggacgggccctgggccccaagggtcctaccccgaagtacccttcccctactaacgttccgttttcgggtccgtacccgttttaaccgacgggggtccctaagggtcgggaaacttcccccaaggccccgtaggttccaaggtcggcaggtggggtctggggacctttcgtcactctcaccatcaaataacctgactaatctcgacgtactttgctagtttatttctgtcagtctagtctagaagtcgtgggtcctttcacgtttccggcgggtaggtaccgaagggtcgacctacgaaacgtactgtacggctcggccaacccgtnttccgttgttcctttaccgtacttaccccgttccccgtcctactaccg

SEQ ID NO: 5193 - DNA, 648 bp, Homo sapiens
  misc_feature: GYAE6OF01EHK5J.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgtaacttagcctggtatcagcagaggcctggccaggctcccagacctcctcatctttggcgtacctttaacgagggtccaggtggaactccccgagccaggttcagcggcaggtgggtctgggacttcgttcactctcaccatcaatacctgacaatctagacgtatttgcttagtttactttctgttacagtctagtcgtagaacgtacttcgggtcccgtttacgtaccgtttccgggacgggtaaccggggtaaccgtaacggggttccggaacccgttaccgaaaaccggtaaccgttgggtaccgggtaccgttacggaccctaacccgtacttcccgttacgttacccgtttacctaacctttcccccgtttacccccggtccctaacgtttaccccggg

SEQ ID NO: 5194 - DNA, 547 bp, Homo sapiens
  misc_feature: GYAE6OF01AQO5F.8.28.C06.1.454.CMB.1.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagacctcctcatctttggcgcctttaacngggccagtggaatcccagccaggtcagcggcagtgggtctgggacttcgttcactctcacatcaataacctgacaatctgacgtactttgactagtttatttctgtcagcagtctagaagacttcgggccgtttcgtaccgtttcgggcgggtacgggaccgaagggtcggacctacaaacgacgtggtggcgtcgcaccgattcgtgttcttactacttccttcccgcctgtccg

SEQ ID NO: 5195 - DNA, 624 bp, Homo sapiens
  misc_feature: GYAE6OF01CTM0S.8.28.C06.1.454.CMB.1.raw
  modified_base (614)..(614): a, c, t, g, unknown or other
  misc_feature (614)..(614): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgtggggagagagccaccctctcctgtgcggccagtcagagcgttaggacgtaacttagcctggtatcagcaaggaggcctggccaggctcccagacctcctcattcgtttggccgtacctttaacgacggggcccaggtacggaactccccgagcctaggttcaggcggcgtaggtggggtctgggtacttcggttcactctcaccatacaaactacctgactaactcgtagtacgtactttcgtacttagttttactttctgttcagtctagtctagaacgtacgtgggtccgttacgtacggtttccgggacgggtacgggtaaccgtaagggttacggtaccgtaacgaaaaccgtacgtagggtacgcgtacgacaaccgtacgttccgtacgttccttacctacttcccttcccncctcgtaccg

SEQ ID NO: 5196 - DNA, 844 bp, Homo sapiens
  misc_feature: GYAE6OF01C96P3.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (833)..(833): a, c, t, g, unknown or other
  misc_feature (833)..(833): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggcctccagagatcattggagaagtggtgatgacacagtctccggtcaccctgtcttgttttccgngggganagacgcccacctctccgtgtgccggccagtcagagtcgttaaggaacgtaacttagcctggtatacgagacgaggacggcctcgggaccgacgggccctacccgaagacccttcctactacgtttccgtttacggcccgttacccgtttaaacgacggggtccctaaggtacgggaaaccttccccgaagtcccggtaagggttacaacgggccggtacgtagggttcggggttccgtagggggtaccttttccggtactaccgttcctaccgaaacctactaacctaaacttaaacccgtgaacctaaacgttcgtacggtaaccgttactttcggtaacgttttaacgtttttaaccgttttcgttacggttaccgtaacggttaccgtaacggtttacgtaaggttaaaccgggttaccggtttaccggggttaccccgtttttaccggtaacccgggttttccgggggaaccggggtaaaccgggtaaacccggttaaacggggttacccggtaaacccgtaaaccgtaaaaccggtaacggttacgggtaccggtacgttaccggaccctaaccgttaacgttccgttcggtttaccttacccgtaacctttccccgtacccccgtntaaccgttcgg

SEQ ID NO: 5197 - DNA, 515 bp, Homo sapiens
  misc_feature: GYAE6OF01AMKKN.8.28.C06.1.454.CMB.1.raw
  modified_base (303)..(303): a, c, t, g, unknown or other
  misc_feature (303)..(303): n is a, c, g, or t
  modified_base (494)..(494): a, c, t, g, unknown or other
  misc_feature (494)..(494): n is a, c, g, or t
  modified_base (513)..(513): a, c, t, g, unknown or other
  misc_feature (513)..(513): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttttcctgggggagagagccaccctctcctgtgcggccagtcagagcgttaggacgaacttagcctggtatcagcagaggcctggccaggctcccagactcctcatctttggcncctttaacagggccagtggaatcccagccaggttcagcggcagtgggtctgggacttcgtcactctcaccatcaataacctgcaatctgacccgatttgctagtttatttctgtcagcagtctgaagctggccgtttcactttcggcggtagggaccaagggtcggacctcaaacgactgtggctgcaccntctgtcttcatctcccgcntc

SEQ ID NO: 5198 - DNA, 724 bp, Homo sapiens
  misc_feature: GYAE6OF01CCFH0.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagacgccaccctctcctgtgcggccagtcagagcggttaggacgtaacttagcctggtatcagcagaggcctggccaggcctcccagacctcctctagttccgtttggccgtacccttttaaacgacggggtccctaggttacggaactccccgaaggcccgtagggttccagggtccgggctaaggttcggggtcgttcgggggtacctttcggtttccaccgttcctacacctattaccaaacttaacctgactaattccgtacgtaaccgttacttttcggactttaacgttttactttacgttggttactaggtcctagttcgtaagaacggtacgttacgggtccgtttaccgtacgttttccgggggacgggtaacggggtaaccgtaacggggttccggaacccttaacggaaaaccggtacgttacgggtacggtaccgttacggactaacccgttacgttcccgttacgttccctttacgtacctttacccgttccccggtcctcgttaccg

SEQ ID NO: 5199 - DNA, 596 bp, Homo sapiens
  misc_feature: GYAE6OF01BHKIC.8.28.C06.1.454.CMB.1.raw
  modified_base (194)..(194): a, c, t, g, unknown or other
  misc_feature (194)..(194): n is a, c, g, or t
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgtaacttagcctggtatcagccagacggcctggccaggcctcccagacctcctnacttctttggcgtcctttaacgngggccagtcggaactcccagccgaggttcagcggcaggtgggtctgggtacttcgtcacgttcacacatacaaactacctgacaatctagacgtactttgacttagtttactttctacgtctacgtctagttctagtaacgcgtcgtacgttctacggttcggacgggtacggtaccgaagggtccgaacctacgaaacggtacttggtacggtccgtcgtaccacctattaccgtcggttccttactactttacccttccccgtactcgttacccgg

SEQ ID NO: 5200 - DNA, 628 bp, Homo sapiens
  misc_feature: GYAE6OF01CAWH4.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
tcagctcgcgtgtccacgaccggtgctcgatttagagctcacgtattggggtttgggggaggaactgctcagttaggacccagacggaaccatggaagccccagcgcagcttctcttctcctgctactctggctccagagatcattggagaagtggtgatgacacagtctccggtcaccctgtcttgtttttccgnggggangacgcccacctctcctgtcgcggccagtcagagtcgtaggacgaacttgcctggtatcgagcaggaggcctggccagggcctcccagtacctcctnacttcgtttcggccgtacctttaacgcgggtccaggtggaactccccagcccgaggttcgaggcggactagggtcgggtcgttggggacctttcggtccacgtcctcaaccattacaaacttacctgactaactctaggaccgttactttgactttagttttactttctacgttcaggtccagtcgtagaacggtacgtcgggtcccgttccgtacgttttcggggaccgggtacggaaccgtaagggtccgacctaacgaaacggtactcggtaggctcggacctaccgtattccgtacgttcttactactcccgttcccgctcgtacg

SEQ ID NO: 5201 - DNA, 638 bp, Homo sapiens
  misc_feature: GYAE6OF01EE8G9.8.28.C06.1.454.CMB.1.raw
  modified_base (195)..(195): a, c, t, g, unknown or other
  misc_feature (195)..(195): n is a, c, g, or t
  modified_base (312)..(312): a, c, t, g, unknown or other
  misc_feature (312)..(312): n is a, c, g, or t
  modified_base (374)..(374): a, c, t, g, unknown or other
  misc_feature (374)..(374): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgtcctttaacgngggccagtcggaactcccagcctaggttcaggcggcaggtgggtctgggacttcgtcactcncaccatcaatacctgactatctgacgtactttgcttagtttactttctgtcagtcagttcgtagaacgtacgtcgggtcccgtttcgtaaccgtttccgggacggggtaacgggtaacccgtaacgggttaccggaacccgttaaccgaaaaccgggtaacgttcgggttaccgggtaccgtacggtaccctaacccgtacgttaccgttaggttaccctttacgtacctttaccccgtttcccccgtaccgtacgttacccgg

SEQ ID NO: 5202 - DNA, 647 bp, Homo sapiens
  misc_feature: GYAE6OF01DSHHJ.8.28.C06.1.454.CMB.1.raw
  modified_base (202)..(202): a, c, t, g, unknown or other
  misc_feature (202)..(202): n is a, c, g, or t
  modified_base (321)..(321): a, c, t, g, unknown or other
  misc_feature (321)..(321): n is a, c, g, or t
  modified_base (404)..(404): a, c, t, g, unknown or other
  misc_feature (404)..(404): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagngacgccaccctctcctgtgcggccagtcagagcgttaggacgtaacttagcctggtatcagcagacggcctggccaggctcccagacctcctctattcgtttggccgtcctttaaacgngggccaggtggaactcccagcctaggtcagcggcaggtgggtctgggactttcgtccacgtctacacctatcaaacttaaccngacaacttcgtacgtaccgtacttttgacttaaggttttactttctgtacagtctagttctaggaacgtacgttcgggtacccgtttgtaccgtttcgggacgggtacgggtaaccgtaagggtaccggaccctaaccggtaaaaccgtaacgttgggttaccggccttacgggaccctacccgtgttacccgttcgttaccctttacctaacttccccctttccccgcgttacccgttacgg

SEQ ID NO: 5203 - DNA, 551 bp, Homo sapiens
  misc_feature: GYAE6OF01CWPRH.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaacttagcctggtatcagcagaggcctggccaggcctcccagactcctcattcgtttggctacctttaacgcgggccaggtggaactcccagccaggtcagcggcaggtgggtctgggacttcgtcactctacacatcaatacctgacaatcgtgacgtactttgacttagtttattctgtcagctagtctagagtcgtggtccgttcgtacgttcggacgggtacggacagggtacgacctacgaaacgtacgtggtgcgtcgccactctcgttacgttcttacctacttcccttacccgcgtatccg

SEQ ID NO: 5204 - DNA, 682 bp, Homo sapiens
  misc_feature: GYAE6OF01DIM5A.8.28.C06.1.454.CMB.1.raw
  modified_base (197)..(197): a, c, t, g, unknown or other
  misc_feature (197)..(197): n is a, c, g, or t
  modified_base (328)..(328): a, c, t, g, unknown or other
  misc_feature (328)..(328): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagacgcccaccctctcctggtcgcggccagtcaggacgtcgttaggacgtaacttagcctaggtatcagcagacggcctggccaggcctcccagacctcctcatcctttggccgtccgtttaacncgggcctaggtcggaactcccagccgaggtcaggcgcaggtggtctgggtacttcgtacactctacacctatacctaataacctgactaactcgtacgtaacgtactttgacttagttttattctggtactaggtactagttcgtaagtaacgtaccgttgggttaccccgtttacgtaccgtttacgggggtaccggggtaacgggtaacccggtaaacgggtacgggtaacccgtaacggaaaacccggttaacgtaccgggtacggtaccgttacggaccctaacccggtatttacccgtgtttacccgttaccgtaacctttccccgttaccccgtcctacgttacccgg

SEQ ID NO: 5205 - DNA, 596 bp, Homo sapiens
  misc_feature: GYAE6OF01ASUYU.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagctggtatcagcagaggcctggccaggcctcccagacctcctcattctttggccgtcctttaacgngggcccaggtcggaactccccagccaggttcaggcggcaggtgggtctgggaccttcgtcactctcactatcaatacctgacaatctagacgtactttgctagttttattctgtcagctagtctgaagtactcggtccgttactacgtttcgggcgggtacgggaaccgtagggtacgtaacccgttacgaaacggtacttgggtacggtcgtacgtaccaccgtagttccgttacgttcctttacctaacttccccgttaccccgcccgttagttacccg

SEQ ID NO: 5206 - DNA, 782 bp, Homo sapiens
  misc_feature: GYAE6OF01AK03P.8.28.C06.1.454.CMB.1.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
  modified_base (251)..(251): a, c, t, g, unknown or other
  misc_feature (251)..(251): n is a, c, g, or t
  modified_base (295)..(295): a, c, t, g, unknown or other
  misc_feature (295)..(295): n is a, c, g, or t
  modified_base (772)..(772): a, c, t, g, unknown or other
  misc_feature (772)..(772): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttcgngggagagcgccacctctcctgcgcgcngtnagagtcgtaggacgtactagcgtgtancgagcgagcgccgtcggcgacggtcctacccgacgtaccttccnctacgtttccgtttcggacccttaccgttaaacggcggtacctaggtaccggtaacctcccgagtaccggtacggttacgacgggccggtacgtaacgggttcggggtaccggttacggggtcccttttacggtacccctaccgttacccgtaaccctaaacccgtaacttaaaccgtaaaacccgtttaaccgtcgtaaaccctaacgtttccggtaaacggtaccggttttaacctttcggttaaaccttttaaggtttttcttacggtcgtaccgtagtaccgtttacgtcgtaacggtaacgttccggttccgggttccgtttaacgtttaccgggttaccggggaacggggtaaccggttaaaccgggtaggttacccgaaccgtaaacggtaaaccggtggttacggtccggaacgtaccggacctaaccgtgtaaccgtttcgttaccctattcccgttacccgttaccntacggttacg

SEQ ID NO: 5207 - DNA, 607 bp, Homo sapiens
  misc_feature: GYAE6OF01AK2NJ.8.28.C06.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgtaacttagcctggtatcagcagaggcctggccaggctcccagactcctcatctttggcnctttaacnggccagtgatccagccagtcagcgcagtggtctgggcttcgtcactctcaccatcaactacctgactaatctagacgtactttgactagtttatttctgtctagcagttctagaagtactcgggtcccgtttcgtaccgtttccggggacgggtacggggaaccctaagggttaccggacccgtacgaaaacggtaccgttacgggtcgggtaccgttcggacctacccgtagtttacccgttcgtttaccctttacctactttacccgtttcccccggtaccctaacgtttcccgg

SEQ ID NO: 5208 - DNA, 774 bp, Homo sapiens
  misc_feature: GYAE6OF01ENACM.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccgtcacctgtcttgtttttcgngggganagacgccacctctcctgtcgcggcagtcagacgtcgttaaggacgtaacttacgccgtaggtatcgagacgagacggccgtggccgacggccctaccgacgtacctcctactacgtttccggttcggacccgttacgttaacggacgggtacctaggtacggacctacccgagtaccgtacggttccgaggccggtagtacggttgggtaccgttacggggttacttccgtttaccaccgtcctaaccaccgtataacctaaagttaaccgtgtaacctaacgttcggtacggtaaccgtttattttacggtaaccttttagttttactttccgaacggtacgtaacggtccgtttaacttcgggtaaccgtaacggtttacccgttccgggttaccgttttacccggtaacgggtttcccgggggaacgggttaaccgggtaacccggttaaggggtaccccgtaaacgttaaccgaaaacggttcggtccgggacgtccgtacccgacccgtacgttcgttcccgttagttacccttacggtaccctttccccgccccgtaatcgtaccgg

SEQ ID NO: 5209 - DNA, 557 bp, Homo sapiens
  misc_feature: GYAE6OF01B3TNE.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (525)..(525): a, c, t, g, unknown or other
  misc_feature (525)..(525): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccngggganagacgccaccctctcctgtgcggccagtcagagcgttaggacgaacttagcctggtatcgagcagaggcctggccaggcctcccagacctcctcatctttggccgtacctttaacgaggggccaggtggaactccccgagccctaggttcaggcggcaggtgggtctgggacttcgtcactctcaccatcaaatacctgactaatctagacgtacttgctagtttattctgtcagctagtctagaacgtctcggtccttctacgtttcgggacggtaacgggaccaagggtcgacctacgaaacgtactggtcggctgccaccngttctgttcttcacttaccctcccgctgtccg

SEQ ID NO: 5210 - DNA, 663 bp, Homo sapiens
  misc_feature: GYAE6OF01BDO2A.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggcgtcctttaacagggccagtggaactccccagccaggttcagcggcaggtgggtctggggacttcgtcactctcaccatacaatacctgactaatctagacgtacttttgcttaagttttactttcgtcgtcaggtctaaggttcctaaggaaacgtaccgttcggggtaccccgttttcgtaaccgttttccgggggacgggtaacgggggtaacccgtaaaggggttaccggaaccccttacggaaaacggtaacccgttgggtaccggtccgttacgggaccctaacccgtacgttcccgttcggtttaccctttaccgaacgtttcccccgtttacccccggcccttaaacgttcccgg

SEQ ID NO: 5211 - DNA, 573 bp, Homo sapiens
  misc_feature: GYAE6OF01CTKIO.8.28.C06.1.454.CMB.1.raw
  modified_base (382)..(382): a, c, t, g, unknown or other
  misc_feature (382)..(382): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagccaccctctcctgtgcggccagtcagagcgttaggacgaacttagcctggtatcagcagaggcctggccaggctcccagactcctcatctttggcgcctttaacgaggccaggtggaatcccagccaggtcagcggcaggtgggtctgggacttcgtcactctcacatcaataaccngcaatctgacgtactttgctagtttatttctgtcagctagtctagaagactggtccgttctacgtttcgggacgggtacgggaccgtaagggtccggacctacgaaaccggtactcgggtcgacgtcgacctaaccgtagttccgttagttaccctttacctaactttcccttccccggcctacgttaccg

SEQ ID NO: 5212 - DNA, 586 bp, Homo sapiens
  misc_feature: GYAE6OF01CGBSU.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcattcgtttggccgtcctttaacgacggggccaggtcggaactccccgaggccgaggttcaggcggctaggtgggtctggggtacttcgttcactctcacatcaatactgacatctgacgtactttgctagtttacttctgtcacgtcgtagtcgtagaacgtacgtcggtaccgttcgtaccgtttcgggacgggtacgggaaccgtaacgggtcggacctacgaaacgtacgtggtcggcgtcgacctaccgtcttcgttgttaccttctacttcccgttcccgcctcgtccg

SEQ ID NO: 5213 - DNA, 780 bp, Homo sapiens
  misc_feature: GYAE6OF01DA4TF.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagcccaccctctcctgtgcggccagtcagagcgttaggacgaacttagcctggtatcagcagaggcctggccaggctcccagtactcttctattcgtttcggcgtacctttaacgacgggacctaggtaggaactccccgaaggcccgtagggttcgaaggccggacgtagggttcggggttaccgttcgggggtaaccttttccggttaccaccgttcctacccgaaccctaataccctaaacttaaaccctgtactaaacgttcctacggtaaccgttacgtttacgtacgtttaagttttactttcgttgttacgacgtactacgttactacggtaacgtaccgttcgggttacccgtttaccgttaacccggttttaccggggaccggggtaacggggtaacccgtaaacgggggttacccgggtaacccgtaaccggtaaaaaccggtaccgttacggggtacgggtaccgtaccggtaaccctaacccgttaacgtttccgtttaccggtttcccgtttaccttaaccgtttaccccgtttaccccccggtaccttaccgttaacccgg

SEQ ID NO: 5214 - DNA, 560 bp, Homo sapiens
  misc_feature: GYAE6OF01AQR17.8.28.C06.1.454.CMB.1.raw
  modified_base (195)..(195): a, c, t, g, unknown or other
  misc_feature (195)..(195): n is a, c, g, or t
  modified_base (310)..(310): a, c, t, g, unknown or other
  misc_feature (310)..(310): n is a, c, g, or t
  modified_base (401)..(401): a, c, t, g, unknown or other
  misc_feature (401)..(401): n is a, c, g, or t
  modified_base (521)..(521): a, c, t, g, unknown or other
  misc_feature (521)..(521): n is a, c, g, or t
  modified_base (551)..(551): a, c, t, g, unknown or other
  misc_feature (551)..(551): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggctcctttaacnggccagtggaactcccagccaggttcagcggcagtgggtctgggacttcgtcactctcaccatcaataacctgacaatctgacgtactttnctagtttacttctagtcagtcagtctgaacgtacgtcggtccgtttctacgtttcgggacgggtacgggaaccgaacgggttcgaaccgtacgaaacgtaacgtcgtcggcgtcgctacncttcctgttccttcgtacttcccgttcccncctgttccg

SEQ ID NO: 5215 - DNA, 556 bp, Homo sapiens
  misc_feature: GYAE6OF01BTTOX.8.28.C06.1.454.CMB.1.raw
  modified_base (194)..(194): a, c, t, g, unknown or other
  misc_feature (194)..(194): n is a, c, g, or t
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggcctcccgagacctcctcattcgtttggcctcctttaacgcgggccagtggaactcccagccaggttcagcggcaggtggtctgggacttcgtcactctcacatcaaatacctgactaatctagacgtactttgctagttttattctgtcagtcagtcngaagtctggtccttntacgttcggacgggtaggtacctaagggtcgacctacgaaacgtacgtggtggctgaccaacctcgttactgttaccttactacttccccttccccggacctgtccg

SEQ ID NO: 5216 - DNA, 548 bp, Homo sapiens
  misc_feature: GYAE6OF01BONWS.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (506)..(506): a, c, t, g, unknown or other
  misc_feature (506)..(506): n is a, c, g, or t
  modified_base (517)..(517): a, c, t, g, unknown or other
  misc_feature (517)..(517): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagacctcctcattcctttggccgtcctttaacgagggcccagtcggaactcccagcccgaggttcagcggcaggtgggtctgggtacttcgtcactctcacatcaatacctgacatcagacgtacttgctagtttactttctgtcagtctagtctgaacgtctggtcccttcacgtttcgggacggtagggacctaagggtcgacctacgaaacgtacgtggnggtctgacacntctgttcttctacttccctcccgtctcgtcg

SEQ ID NO: 5217 - DNA, 590 bp, Homo sapiens
  misc_feature: GYAE6OF01BES6L.8.28.C06.1.454.CMB.1.raw
  modified_base (196)..(196): a, c, t, g, unknown or other
  misc_feature (196)..(196): n is a, c, g, or t
  modified_base (394)..(394): a, c, t, g, unknown or other
  misc_feature (394)..(394): n is a, c, g, or t
  modified_base (434)..(434): a, c, t, g, unknown or other
  misc_feature (434)..(434): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagagcggttaggacgaacttagcctggtatcagcaggaggcctggccaggcctcccagacctcctcattcgtttggccgtacctttaacgacggggccaggtcggaactccccagcccgtaggttcaggcggcaggtgggtctgggtacttcgtcactctcacntacaatacctgacaatctagacgtactttgacttagtttnttctgtcagtcagtcagaacgtcgtcggtccgttacgtacggttcgggacgggtaacggtaccgtaagggttcgacctaacgaaacgtacgtggtacggtcgtacgaccactattccgtcgttaccttaccacttccccttacccgcttacgtacg

SEQ ID NO: 5218 - DNA, 714 bp, Homo sapiens
  misc_feature: GYAE6OF01CGIDU.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctccagagatcattggagaagtggtgatgacacagtctccggtcaccctgtcttgtttttccgnggggagagacgcccaccctctcctgtcgcggccagtcagagtcgttaggacgtaacttagcctggtatcagcgaggaggtccgtggaccacggcctacccagtacctcctatacgttcgtttggccttacccgtttaacgacggggccctaagggttcggaaacctaccccgacggcccgtagggttacgacgggccgggtacgtaagggttcggggttccgtagggggttaccttttccggttcctaaccgttcctaccaacctacttaaccaaacgttaacccgtgaactaactcgtacgtacgttaccttttgacgtttagttttactttcgtcgtacgtagtctagttacgtagtaacggtacgttccgggtcccgtttcgttacgggtttccgggacggggtaaccgggaccgtaagggtaccggaacctaacgaaaccggtacgttcggacggtaccgtcgaccacgtcttcgttcgttaccttacttacttccccgttcccgcctgtcccgg

SEQ ID NO: 5219 - DNA, 759 bp, Homo sapiens
  misc_feature: GYAE6OF01DC5AR.8.28.C06.1.454.CMB.1.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggganagagcccaccctctcctgtgccggccagtcagagcgttaggacgaacttagcctggtatcagcagacggcctggccaggcctcccgagacctcctctattcgtttcggaccgtaccttttaaacgacgggtacccgtaggttacgggaaactcccccgaaggccccgtaacgggtttaccgaacgggtccgggacgtacgggtttcggggggttccgttacgggggtaccttttccggtttacctacccgttacctacccaccgtaaacgtacctaaaacttaacccgttaggtacctaaacgttccgtacggtaaccgttaccgttttacgtaccgtttaacgtttttaactttccgtacgttcctacggtaccttacggtacgttacggaacggttacgtcgggttcccgttccgtaccggtttccgggaccggggtacgggaaccgtaagggtaccggtaccgtaaccgaaacggtaacgtggtcggtacgtacgacctaccgtgttaccgttcgttaccttactaccttcccgttaccccgctacgtaccg

SEQ ID NO: 5220 - DNA, 731 bp, Homo sapiens
  misc_feature: GYAE6OF01BY1UX.8.28.C06.1.454.CMB.1.raw
  modified_base (200)..(200): a, c, t, g, unknown or other
  misc_feature (200)..(200): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtcctccggtcacccgtgttcttgtttttccgnggggagagacgccaccctctcctggtcgcggccagtcagagtcgttaaggactaacttagcctggtatcgagacgagacggcctgggccacggcctacccgacgtacctccctacgtacgtttccgtttcgggaccttacccgtttaacggacgggtacctaaggttacggaactaccccgaggtacccgtagggttaccgacgggccggtacggtacgggttcggggtaccgttacggggtacctttcggttacctaacgttccacctaacctaatacctaaaactaacccgttgactaacgtccgtaagtaccgttactttacgacttagttttacttagtgtactagaccgtagtacgtaagaacggtcttaccgggtccttacggtaaccggttcggggacggggaacggtaaccgtagggtaccgtaacctaacggtaaacgtaacgtcggttacggaccgtacgtacacccgttattccgtacgttccctttactaccctttccccgacccgtacgttagtaccg

SEQ ID NO: 5221 - DNA, 654 bp, Homo sapiens
  misc_feature: GYAE6OF01CVLHS.8.28.C06.1.454.CMB.1.raw
  modified_base (195)..(195): a, c, t, g, unknown or other
  misc_feature (195)..(195): n is a, c, g, or t
  modified_base (291)..(291): a, c, t, g, unknown or other
  misc_feature (291)..(291): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagtcgttaggacaacttagcctggtatcagcagaggcctggccaggctcccagactcctnatcgtttggcgtcctttaacgagggtccaggtcggaactcccagcctaggttcagcggctaggtcgggtcgtgggactttcgtcactctccacctatcaaactaaccgtgacaatctcgtaccgtactttagcgttagttttactttcgtcgttacgacgtcgtaagttcgtacggtaacgtacgtacgggttcccgtttccgtacggttttacccggggacgggtacggggtaaccgtaacgggttacggacccgtaaccgtaaaccggtaacgtcgggttacgggcgttacggacccgtacctacgttcgttaccgttcgttttaccaccgtttcccttccccgtaccgtacgttacccgg

SEQ ID NO: 5222 - DNA, 607 bp, Homo sapiens
  misc_feature: GYAE6OF01CPJPR.8.28.C06.1.454.CMB.1.raw
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
  modified_base (576)..(576): a, c, t, g, unknown or other
  misc_feature (576)..(576): n is a, c, g, or t
  modified_base (604)..(604): a, c, t, g, unknown or other
  misc_feature (604)..(604): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagngcgttaggacgaacttagcctggtatcagcaggacggcctggccaggcctcccagacctcctctattcgtttcggccgtccctttaaacgacgggtcccaggtgggaactccccgaggacccgtagggttcaggccggacgtaggttggggtcgttcggggtacctttcggttacacctcctacacctataccaaattaaccctgacaacttctagtacgtactttgacttagttttactttctgtacagtactacgtctaggaacgtactcggtcctttcgacgtttcgggacgggtacgggacgtaagggtcgacctacgaacgtacgtacgtggctgcactntcctgttccttctacttccttcccgctntcg

SEQ ID NO: 5223 - DNA, 724 bp, Homo sapiens
  misc_feature: GYAE6OF01B2WDD.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagcccaccctctcctgtgcggccagtcagagcgttaggacgaacttagcctggtatcagcagacggcctggccaggcctcccagacctcctcattccgtttcggcgtaccctttaacgagggcccaggtacggaactccccgagcccgtaggttccaggcggaccgtaggtggggtccgtaggggtacctttccgttccgaaccttctaccacctactactaaacgtacctgaacctactcgtacgtaccgttacgttacgtacgtttaagttttactttcgtaccgtacgtacgtacggtacgttccggtaagtaacgtaccgtccgggttaccgttaccgttacccgggtttacgggaccggggtaaccgggtaaccggtaacgggttaccggtaacccgtaaccggtaaaccggtacggttcggtaccggtaccgtaccggtaccctaaccgttaccttccgttacgtttacccgttaccgttaccttacccccgttccccgtaccttacgttaccgg

SEQ ID NO: 5224 - DNA, 683 bp, Homo sapiens
  misc_feature: GYAE6OF01AR97N.8.28.C06.1.454.CMB.1.raw
tcagctcgcgtgtccacgaccggtgctcgatttagagctcacgtattgggtttggggaggaacgtgctcagttaggacccagacggaaccatggaagccccagcgcagcttctcttcctcctgctactctggctcccagagatcattggagaagtggtgatgacacagtctccggtcaccctgtcttgttttcctggggagagagcccacccttctcctgtgcggaccagtcagagcgttagacgaacttagcctggtatcgagcaggacggcctaggccagggcctccccgagaccttcccgtctaacttcgtttggcccgtccttttaaacgacggggtccaaggttcggaaacttccccgaacgcctaagggttccaggcccgggctaggtcgggtcgtaggggacctttcgtttcgacctctaccgacctactctaaactaaccctgaacctaatctacgaccgtactttcgacttatttactttctacgtcgaagtctacggtccttagggaaccgtacgtacgggttcccgtttataacccggttttcggggaccgggtacgggaacccgtaaggtcccgggtaaccgtaccaaaaccggtagttcggtaggtacccgtgacccgacctcgttacgtacttcgttccgtaacttcccggttaccctcgtcttaccgg

SEQ ID NO: 5225 - DNA, 578 bp, Homo sapiens
  misc_feature: GYAE6OF01EO1FH.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (543)..(543): a, c, t, g, unknown or other
  misc_feature (543)..(543): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaacttgcctggtatcagcagaggcctggccaggcctcccagacctcctcattctttggccgtcccttttaacgaggggccaggtggaactccccagccaggttcagcggcaggtgggtctgggacttcgtcactctcaccatacaataacctgactaatctagacgtactttgctagttttattctgtcagtctagtctaggaacgtacgtcggtcccgtttctaaccggtttccgggacgggtacgggtaccgtaaggggtcggaaccctacgaaaacgtacgtggtggctggaccaccnttcctgttccttcacttccctttccccgctctccg

SEQ ID NO: 5226 - DNA, 571 bp, Homo sapiens
  misc_feature: GYAE6OF01E1CN5.8.28.C06.1.454.CMB.1.raw
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtcttcggtcaccctgtctgtttttcctggggagagagccaccctctcctgtgaggccagtcagagcgttaggacaacttagcctggtatcagcagaggcctggccaggcctcccagacctcctcatctttggctcctttaacngggccagtggaactcccagccaggttcagcggcaggtgggtctgggacttcgtcactctcaccatcaatacctgactatctagacgtactttgacttagtttatttcgtgtcagtcagtctagaagtaccgtggtccgtttcgtaacgtttcgggacgggtagggaccgtaagggtcggacctacgaaacgtacgtggtacggtcgtcgactacctagttcctagttccttctacttcccgttccccgtctacgttaccg

SEQ ID NO: 5227 - DNA, 555 bp, Homo sapiens
  misc_feature: GYAE6OF01BQG4B.8.28.C06.1.454.CMB.1.raw
  modified_base (311)..(311): a, c, t, g, unknown or other
  misc_feature (311)..(311): n is a, c, g, or t
  modified_base (386)..(386): a, c, t, g, unknown or other
  misc_feature (386)..(386): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggccgcctttaacngggccagtggaactcccagccaggttcaggcggcagtgggtctgggtacttcgtcactttcacctatcaataccngacaatctgacgtactttgcttagtttatttctgtcagctagtctagaagtcgtggtcccgttcgaccgtttcgggacgggacgggtaccgtaagggtcgaacctacgaaacgtaacgtggtcggctcgcaccatctgtccttactacttcctacccgcctatcgtacg

SEQ ID NO: 5228 - DNA, 571 bp, Homo sapiens
  misc_feature: GYAE6OF01ASPNR.8.28.C06.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
  modified_base (432)..(432): a, c, t, g, unknown or other
  misc_feature (432)..(432): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggganagacgccaccctctcctgtgcggccagtcagagcgttaggacgaacttagcctggtatcagcagaggcctggccaggctcccagactcctcatctttggcncctttaacagggccagtggaatcccagccaggttcagcggcaggtggtctgggacttcgtacactctcaccatcaataacctgacaatctgaccgtactttgctagttttattctgtcagtcagttacngaacgtctgggacctttccacgtttccgggcgggtaagggacctaagggtcggaaccctacgaaaaccggtctaggtcggtacctcggaccaaccagttccttcgttcttaccactttcccgtccccgtcctaagttcg

SEQ ID NO: 5229 - DNA, 835 bp, Homo sapiens
  misc_feature: GYAE6OF01BK2WF.8.28.C06.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgtcttgtttttccgngggganagacgcccaccctctccgtgtcgcggccagtcgagagtcggttaaggacgtaacttagccgtaggtactcgagcgaaggacggcctggaccacgggcctacccagacctccctatacttcgtttcggaccttaccgtttaaacgcgggcctaaggtacggaaacctccccgagacccgtagggttccgaacggccgggaccgtagggttcggggttaccggtacggggtaccgtttccggttacctaaccgttccctaccctaacctaaccttaacgaaacctttaacccgtgaaccttaacgttcgttacggtaaccgtttaccgttttacgttacgtttaggtttttaacttttccgtaggttacctacggtaaccgttacggtttacgtaacggaaacgttaccggtttccgggtacccggtttacccgttacgggttttcccgggggaacggggtaaccgggtaaaccggtaagggttacccgggaacctttaaaccggaaaccggttacgttacgggtaccgggttaccgtaccggtacccgtaacccgttacgttacccggtttattacccccgttttacgtaccccgtttacccccgtttccccgaacccttggttaaccccgg

SEQ ID NO: 5230 - DNA, 598 bp, Homo sapiens
  misc_feature: GYAE6OF01BK5L2.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgcctttaacagggccagtggaactcccagccaggttcagcggcagtgggtctgggacttcgtcactctcaccatcaatacctgacaatctgacgtactttgctagtttatttctgtctagctagtctagaacgacgtcggccgtttcctacgtttccgggacgggtaacggggtaccgtaacggggtacggaacccgttacgaaaacccggtaacgttaggtacgggtaccgtcggacccaaccgtactcccgttgttacccttctacgttacccgtttccccgacgtacgttaccgg

SEQ ID NO: 5231 - DNA, 889 bp, Homo sapiens
  misc_feature: GYAE6OF01DOLZ2.8.28.C06.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
tcagctcgcgtgtccacgaccggtgctcgatttagagctcacgtattggggtttgggggaggaactgctcagttaggacccagacggaaccatggaacgccccagcgcagcttctcttcctcctgctactctggcctccagagatcattggagaagtggtgatgacacagtctccgtcaccctgtcttgtttttccgngggganagacgccctaccctctcctggtcgccggccagtcaggtagacgttaggaacgtaacttagccgttaggtactacgaagaccgaaggaccgggtcctcgggacccacgggcctacccgaacggtaccttcctactacgtttccgttttcgggaccgttacccgtttaaagaccggggaccctaagggttcggaaacctcccgaggtcccggtaacggttcgaagggtccgtacggtacggtttggggtaccgttagggggtaacccttttcgggttacctaccgttaccttacccgaacccttaaacgtacctaaaaccttaaacccgtcggtaaacctaacgtttacccgtaacggtaaccgtttaaccgttttcggtaaccttttaaggtttttaacctttccgttacggttaaccgtaacggtaccgttaacggttaccgttaacggtaaaaccggttaccgggtttacccgggttaacccgggttttacccggttaaacccgggttttaccgggggaacccgggggtaaaccggggtaaacccggtaaacggggttaccgggtaaccctaaaccggtaaacgggttaccgtaacgggttcggtaccggtaccgtaccgaacccttcgtttactaccgtttaccgttcctaccgttacccgtttccccaaggttcctaaccgg

SEQ ID NO: 5232 - DNA, 714 bp, Homo sapiens
  misc_feature: GYAE6OF01BPHGF.8.28.C06.1.454.CMB.1.raw
  modified_base (197)..(197): a, c, t, g, unknown or other
  misc_feature (197)..(197): n is a, c, g, or t
  modified_base (268)..(268): a, c, t, g, unknown or other
  misc_feature (268)..(268): n is a, c, g, or t
  modified_base (442)..(442): a, c, t, g, unknown or other
  misc_feature (442)..(442): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgccaccctctcctggtgccggccagtcagagtcggttaaggactaacgttcgcctggtaancagcagacggcctggccaggcctacccagtacctcctacacttcgtttcggccgttaccgtttaacgacgggtccaggttacggaacctcccgagaccgtaggttcacggcggtacaggtcgggtcgtggtactttcgtacgtctccgtacacctaagtactaaacttaaccgngacctaactccgtagtaccgttactttgactttaacgtttatttccgttagtactacgtacttagtcgttaggaaccgttcggttccgggttccgtttaaccgttaccggtttccggggaaccggggtaaccgggtaccggtaagggtacccgttaacccgtaaccgaaaacgttcggttaacggtcggtacccgtacgtaccctaaccgtacgtttcttaacgttcccgtttacctaccgtttacccttaccccgtcgttacgttacccgg

SEQ ID NO: 5233 - DNA, 687 bp, Homo sapiens
  misc_feature: GYAE6OF01EN4Y4.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (648)..(648): a, c, t, g, unknown or other
  misc_feature (648)..(648): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccaccctctcctggtgccggccagtcaggagcggttagacgtaaattgcctggtatcagcaggacggcctggccaggcctccagtacctcctanattcgttcggccgtaccgtttaaacgcgggcctaggtcggaactcccgagtccgtaggttcgacggtcggcgtaggtcgggtacgtcggggtacctttcggttaccaccttccgtacctaaccgtacttaaccgtaaaaccgttaaacccgtaggtacctaaaacgttccgttacgtaaccggttaacgtttttcgaacgttttacgtttttaacttcggttagttaccgtacgtacgtaacgttcgtaacgtaacgtacgtccggttaccgttcgttacggttccgggacggtaacggtaccgtaaggtacgtacctaacgaaacgtacgtggtcgcgtcgacncgattcctagtccttacgtacttccctaccgtctgtacg

SEQ ID NO: 5234 - DNA, 730 bp, Homo sapiens
  misc_feature: GYAE6OF01C0ABJ.8.28.C06.1.454.CMB.1.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
tcagctcgcgtgtccacgaccggtgctcgatttagagctcacgtattggggtttgggggaggaactgctcagttaggacccagacggaaccatggaacgccccagcgcagcttctcttcctcctgctactctggcctcccagagatcagttggagaagtggtgatgacacgagtcctccggtccaccctgttcgtttgtttttccggnggggagacgacgccaccctctccgtgcgcgcagtcagngtacgtaggactactgcctgactcgagcgaaggcggtccgcggccgacggccctacccgagtacccctcctacgtacgtttccggtttacggacccgttaccgtttaaacggaccgggcctaaggttacgaaccttcccgagtacccgtaggttacgaacggcgggtacgtcgggttacggggtcgttacggggtacctttcgtaacccttccgtacctaccgtaactactaactaaaccgttactacgtaactacgttacgtacggttaccgttaactttcgtactttacgttttacgttcgttagtaccgtacggtacgtagtaccgttaagtacggtacgttccgtttccgtcgttacgggtccgggaacgggtacgggtaacgtacgggtaccggtacctaacgtaacggtacgtcggtacgtacgtacgacctacgttatccgttacgttctacgtaccgttccctacccgcctgtacg

SEQ ID NO: 5235 - DNA, 720 bp, Homo sapiens
  misc_feature: GYAE6OF01A65JL.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgccaccctctcctgtgcggccagtcagagcgttaggacgtaacttagcctaggtatcagcaggacggcctggccaggcctcccgagtacctccctctacgtttccgtttacgggccgtacccgtttaacgacggggtccctaaggttcggaactccccgaagacccgtaggttccgacggccggtacgtaacggttcggggttcgttacggggtaccttttccggtttaccgacctttcccgtacccaaccttaactacctaaaacttaacccgtgtaacctaacgttccgtacggtaacgttacgttttgtactttacgttttaatttcgttagtactaagtcctagttaccgtaggaacgtacgtcggtccgttacgtacggtttccgggacggggtaacggaccggtaagggtaccgtaccgtaacgtaaacggtaccgttgtacgggctacgtaccacctacgtacgtcgttactttacccgcgtttccccgtaccctcgtacgttaccg

SEQ ID NO: 5236 - DNA, 726 bp, Homo sapiens
  misc_feature: GYAE6OF01DU6QN.8.28.C06.1.454.CMB.1.raw
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (239)..(239): a, c, t, g, unknown or other
  misc_feature (239)..(239): n is a, c, g, or t
  modified_base (267)..(267): a, c, t, g, unknown or other
  misc_feature (267)..(267): n is a, c, g, or t
  modified_base (712)..(712): a, c, t, g, unknown or other
  misc_feature (712)..(712): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtcctccggtcaccctgttcttgtttttccgngggganagacgccaccctctcctggtcgcggcagtcagngtcggttagactaacttagcctggtacnagacaaggccgtggcccacgggcctaccgagtaccctccgtactactttcgttcgggtccgttacccgtttaaacgcggggtaccgtaggtacgggaacctccccgaaggtacccgtaagggtttcccgaagggtccgggtacgtaacggggttcgggttcgttacggggtccctttaccggttctaaccgttcgtacctaacctatacctaaaactacccgtagacctaacttcgtacggaaccgtttctttaggctttaacgttttattcgtgttcagtctacgtcgtagaactcggtcggttccctttgtaccggtttaccgggacgggtaacgggttaaccgtaagggttacgaaccccgttaacggaaacgtaggttccgtacggtctacgggaccctacgtagttccttcggttacttccgtaacttccccgttaaccnctaatcgtaacggg

SEQ ID NO: 5237 - DNA, 625 bp, Homo sapiens
  misc_feature: GYAE6OF01CN63I.8.28.C06.1.454.CMB.1.raw
  modified_base (409)..(409): a, c, t, g, unknown or other
  misc_feature (409)..(409): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagacgccaccctctcctgtgcggccagtcagagcggttaggacgaacttagcctggtatcagcagacggcctggccaggcctcccagacctcctcacttctttggccgacctttaacgacggggtacccaggttaggaactccccaggtccgtaggtcaggcggcaggtcgggtctggggtacttcgtcactctcacatcaataaccngcaatctagacgtactttgacttagttttacttacttcgttacgagtcctagttctaggaaacgtccgtcgggtaccgtttcctaccggtttccgggacgggtacgggaaccgtaacgggtacggaccctaacgaaacggtacgttcggtaggccgtcgaccctacctagttcctaggttcccttacgaccttacccttccccgtcctagttaccg

SEQ ID NO: 5238 - DNA, 611 bp, Homo sapiens
  misc_feature: GYAE6OF01AZ79U.8.28.C06.1.454.CMB.1.raw
  modified_base (200)..(200): a, c, t, g, unknown or other
  misc_feature (200)..(200): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagagcctggccaggctcccagactcctcatctttggctcctttaacgaggccagtcggaactcccagccagttccagcgcagtgggtctgggacttcgtcacgtctccaccatacaaataacctgactaatctagacgtactttgctagtttaactttctgttccaggctagttctacgaagtactcgggtcccgtttacgtaccgtttacgggaccgggtacgggtaaccgtaacgggtcggaacccgttacgaaaaccggtacgtacggtacggaccgttcgaccgaacccgtctaccgttacggtcctttacccgactttaccccttcccggcccttaacgttcccg

SEQ ID NO: 5239 - DNA, 548 bp, Homo sapiens
  misc_feature: GYAE6OF01BK1ZH.8.28.C06.1.454.CMB.1.raw
  modified_base (195)..(195): a, c, t, g, unknown or other
  misc_feature (195)..(195): n is a, c, g, or t
  modified_base (202)..(202): a, c, t, g, unknown or other
  misc_feature (202)..(202): n is a, c, g, or t
  modified_base (513)..(513): a, c, t, g, unknown or other
  misc_feature (513)..(513): n is a, c, g, or t
  modified_base (521)..(521): a, c, t, g, unknown or other
  misc_feature (521)..(521): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggganagagccaccctctcctgtgcggccagtcagagcgttaggacaacttagcctggtatcagcagaggcctggccaggcctcccagacctcctcatctttggcgtcctttaacgaggggccaggtggaactcccagccaggttcaggcggcaggtgggtctgggtacttcgtcactctcaccatcaatacctgacaatctagacgtactttgctagttttatttctgtcagtctagtctagaagtacgtcgggtccgttctacgtttcgggcgggtacgggaccgtaagggtcggacctacgaacgaacgtggngctgcacntcgtgtcttcacttcctcccnctntcg

SEQ ID NO: 5240 - DNA, 581 bp, Homo sapiens
  misc_feature: GYAE6OF01BI95B.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgtcctttaacagggccagtggaactcccagccaggttcagcggcagtggtctgggacttcgtcactctcacatcaaatacctgacaatctagacgtacttgactaagtttactttctagttcagtcagtctagtaagtcgtcggtccgttctacgtttcgggcgggtaacgggaccgtaagggtacggacctaccgtaaacgaacgtcggtaggccgtggaccaccgtattcccgttaggttcccttactaccgttacccgtttccccgcctacgttaccg

SEQ ID NO: 5241 - DNA, 531 bp, Homo sapiens
  misc_feature: GYAE6OF01BH98C.8.28.C06.1.454.CMB.1.raw
  modified_base (310)..(310): a, c, t, g, unknown or other
  misc_feature (310)..(310): n is a, c, g, or t
  modified_base (505)..(505): a, c, t, g, unknown or other
  misc_feature (505)..(505): n is a, c, g, or t
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggctcctttaacngggccagtggaactcccgagccaggttcagcggcaggtgggtctgggacttcgtcactctcaccatcaataacctgacaatctgacgtacttgctagtttattctgtcagctagtctgaagctggtccgttactacgtttcggcggtagggacctaagggtcggacctacgaaacgacgtgtggcgtcgacactntctgtcttcacttcctcccnctntcg

SEQ ID NO: 5242 - DNA, 802 bp, Homo sapiens
  misc_feature: GYAE6OF01DCI8M.8.28.C06.1.454.CMB.1.raw
  modified_base (197)..(197): a, c, t, g, unknown or other
  misc_feature (197)..(197): n is a, c, g, or t
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgcccaccctctcctgtgtcggccagtcagagtcgttaggactaacttgcctggtancagcaggcgcctggccgaggcctaccagacctccctntacgttcgttttggccgtacccgtttaaacgcgggtccctaaggttacgggtaactcccccgtaggtacccgtacgggttaccaagggcgggtaccgtagggttcgggggttccgttacgggggtaccttttccggttacctacgttacctaccgaccctaataccctaaaaccttaacccgtgacctaaagttcccgtacggtaaaccgtttaccgttttaggtaacccgttttaagtttttacttttccgtacgtaccgtagggtaccctacgttccgttaaggtaacgtaccgtttccgggtacccgttttaacgtaccgggttttccgggggacgggtaaccggggaacccggttaagggtacccggtaaccctaaacggtaaaacccggtacgttcgggtaccggtacgttacggacccttaaccggaccgttttaccgttcttacccggttttacctacccgtttccccggtaccccctacgttcgtttaacccgg

SEQ ID NO: 5243 - DNA, 570 bp, Homo sapiens
  misc_feature: GYAE6OF01EIW6Q.8.28.C06.1.454.CMB.1.raw
  modified_base (195)..(195): a, c, t, g, unknown or other
  misc_feature (195)..(195): n is a, c, g, or t
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctccagacctcctcatctttcggctcctttaacgngggccagtggaatcccagccaggttcagcggnaggtgggtctgggacttcgtcactctcaccatcaatacctgacaatctagacgtactttgctagtttactttctcgtcagtctagtctaggaacgctcgggtccgttctacgtttcgggcgggtagggaccgtaagggttcggacctaacgaaacgtaacgtggtacggcgtcgacaacctcgtcttcgttcttacctacttaccccgttcccgtcctcgttaccg

SEQ ID NO: 5244 - DNA, 602 bp, Homo sapiens
  misc_feature: GYAE6OF01DJ8UL.8.28.C06.1.454.CMB.1.raw
  modified_base (195)..(195): a, c, t, g, unknown or other
  misc_feature (195)..(195): n is a, c, g, or t
  modified_base (397)..(397): a, c, t, g, unknown or other
  misc_feature (397)..(397): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcattctttggcgtcctttaacgaggggccaggtggaactcccgagccaggttcagcggcaggtgggtctgggacttcgttcactctcaccatcaatacctgcaatcngacgtactttgctagttttactttctgtcagtctagtcgtaggaacgtacgttgggtacccgtttacgtaccggttttaccggggaccggggtaacggggaacccgtaagggttcggacccttaacggaaaaccgtaacgtggtaggccgtacggaccacctagttccgttgttccttctaacttcccttccccgcctactaccg

SEQ ID NO: 5245 - DNA, 812 bp, Homo sapiens
  misc_feature: GYAE6OF01CVHCY.8.28.C06.1.454.CMB.1.raw
tcagctcgcgtgtccacgaccggtgctcgatttagagctcacgtattgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaaagagccaccctctcctgcaggccagtcagaatgttggcgcttcgtaagctaggtaccaacgacaaaccgtggaccaggcctcccgacggccccctcatctatgggtcgcatccaacacggggcccaacgtggacctactaccccgacgaccccgtaagggtttccaacggttcggccgtaagggttcgggggttaattcgggggaaactaacggtaacctttccgacctttaccctacaaaccctatacctataccgaacggtccctacgggaacggtacccgttaggaacggtaacgttacggtttcggtacgttaaggtttttaactttaaccgtttacgttaacgtaaaccgtacgtttacccggtaaccgggttaacggttccggggtccccggttaccccggggggggttaccccttaacccggtttttccccggggaccccggtttacgggggtaaaccccggtaaacgggggttaccgggtaaacggtaacggtaaacccgtaaaaacgggtaaccggttacgggttacggggtaccgttcgggtaccctaacccggttaacgttccgtttacccgtttccgtttcccgttaacccgg

SEQ ID NO: 5246 - DNA, 662 bp, Homo sapiens
  misc_feature: GYAE6OF01B1B46.8.28.C06.1.454.CMB.1.raw
tcagctcgcgtgtccacgaccggtgctcgatttagagctcacgtattggggtttgggggaggaactgctcagttaggacccagacggaaccatggaagccccagcgcagcttctcttcctcctgctactctggcctccagagatcattgggagaagtggtgatgacacagtctccggtcaccctgtcttggttttccgtggggagagacgcccaccctctcctggtcgcggccagtcagacgcggttacggacgtaacttaggccgttaggtactcgaggcgtaggacggccgtggcctacgggcctcccgagtacctcctatacgttcgtttcgggaccgttacccgtttaaacggacgggtaccgtaggtacggtaacctcccgaacggtccgtaacgggtcgacggtcggcgtaggtcgggtcgtagggtaccttcgtacacttctaccgactcgtacaacttacgtgactatcgtagtacgtacgtttgactttaggtttacttcgtagtcgtaggtcgttctagaacgtcgacgttcgtccgttacgtcggtacggacggtacgacgtcggtaccgacgtaaacgtacgtcgcggtgaccgtcgtacaccgttgtcgttacctcgttaactccgttacccctcgtacctggtacccg

SEQ ID NO: 5247 - DNA, 613 bp, Homo sapiens
  misc_feature: GYAE6OF01DMFFG.8.28.C06.1.454.CMB.1.raw
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgtggggagagagccaccctctcctgtgcggccagtcagagcgttaggacgaacttagcctggtatcagcagaggctggccaggctccagactcctcatctttggcncctttaacgngggccagtggaactcccgaagccgtagttcagcgcaggtgggtctgggacttcgttcactctacaccatcaataacctgacaatctgtacgtacgtttgcttagtttatttcgtcgtctgactagtactagaacgtacgtcggtcgttcctacggttttacgggacgggtaacgggtaccgtaagggtaccggtacctacgaaaacccggtacgttacggtacggtcgttacggaccgtaacccgtagttaccttcggttacctttaccgtaccgttacccctttccccgcgtacttaccggg

SEQ ID NO: 5248 - DNA, 902 bp, Homo sapiens
  misc_feature: GYAE6OF01CYEIX.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagccaccctctcctgtgcggccagtcagagcgtaggacaacttagccgtaggtatcagcaggacggcctgggacctagggcctacccgagtacctccctactattcgttttcgggccgtacccgttttaacgacggggtaccctaagggtcggaaacttacccccgaaggcccgtaacgggtttccgaacgggtcgggaccgtagggtttaccgggggtctacgggggttaaccctttcggtttacctaccgttacctacccaaccctaataacctaaacttaaaccctcggaacctaacgttaccgttacggttaaccccggttaattttccggtaacgtttaacgttttttaacgtttccgtttagggttaccctaacgggtacctttaaacggtaccggtttaacggtaaaacggttacccggtttacggggttaaccccggtttttacccggttaacccgggtttttacccgggggaacccgggggtaaaccgggggtaaacccggttaaacgggggttacccgggtaaaccccgtttaaccggaaaaaaccgggttaaccgttaccgggtacgggggttaccctacgggtacccccgaaaccggttaaccgtttccggtttaacccgttccgttttaaacccacccggttttacccctttaccccccgggtcttaacccgtttaaccccggg

SEQ ID NO: 5249 - DNA, 575 bp, Homo sapiens
  misc_feature: GYAE6OF01ELHNK.8.28.C06.1.454.CMB.1.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (291)..(291): a, c, t, g, unknown or other
  misc_feature (291)..(291): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagngcgttaggacgaacttagcctggtatcagcagaggcctggccaggctcccagacctccnctattctttggccgtccttttaaacgagggccaggtgggaactcccagccaggttcagcggcagtgggtctggggtacttcgttcactctcacatcaaataacctgactaatctagacgtactttgcttagtttactttctgtcagtctagtctggaagtacgtcggtccgtttcgtacgtttcgggcgggtaagggaccgtaagggtcgaacccgtacgaaacggtaactggtcggcgtcgaccactgtctcgttccttctacttccttccccgcctgtaccg

SEQ ID NO: 5250 - DNA, 810 bp, Homo sapiens
  misc_feature: GYAE6OF01DFJF4.8.28.C06.1.454.CMB.1.raw
  modified_base (199)..(199): a, c, t, g, unknown or other
  misc_feature (199)..(199): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgttctttcgtttttccgnggggagacgacgcccacctctcctgtcgccgccagtcaaggacgtacggttaaggaaccgtaacgttacgccgtaggtactacgaggacaggtacggcctggcccgaggtccctacccgagtacctcctagtactttcggtttcggacccgttaaccgtttaacgacggggtccagggttaccgaaacctcccgaacgtccgtacggtcgacggcggacgtaagggtcgggttcgtacgggttaccttccgtcctaccttccactaaacctacgtaaactaaaccgtaactcgtaactaacgttccgtaacgtaaccgttaacgttttgtacgttttaagtttttacgtttcgtacggtacgtaacggtaccgttaacggtttacgaagggttaaaccggtacggtttccgggtttaacccgtttccggttaacccggggtttaccgggggaacggggtaaacccgggtaaacggttaacgggtaccggttaaacccgaaacgtaaaaccggtcggtcgggttaaccggaccgtcggtaacctaacccgtcgtttaccgttcggtttaccctaccttaccgttaccccgtacccgtacgttaacgttccgg

SEQ ID NO: 5251 - DNA, 665 bp, Homo sapiens
  misc_feature: GYAE6OF01DJHET.8.28.C06.1.454.CMB.1.raw
  modified_base (195)..(195): a, c, t, g, unknown or other
  misc_feature (195)..(195): n is a, c, g, or t
  modified_base (323)..(323): a, c, t, g, unknown or other
  misc_feature (323)..(323): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagacgccaccctctcctgtgcggccagtcagacgcgttaggacgtaacttagcctggtatcagcaaggacggcctggccaggcctcccagacctctcattctttcggccgtacctttaacgngggcctagtacggaactccccgagccaggttccaggccggcaggttgggtctgggggacctttcgttccacttcctcaacccattacaaactaccgttgacctaattccgtagtaaccgtactttgactttaagttttactttcttcgttacaggtcctaggttcgtaacgggaacttaccggtcgggtacccgttttccgtaacggttttccggggacggggtaacgggaaccgtaagggttaccggacccttaagaaaaccggttaacgtggtaccggtacgtcggaccctaactcgtaccgttgtttcccttactaccgttcccttcccggactgtacg

SEQ ID NO: 5252 - DNA, 663 bp, Homo sapiens
  misc_feature: GYAE6OF01B7JSK.8.28.C06.1.454.CMB.1.raw
  modified_base (320)..(320): a, c, t, g, unknown or other
  misc_feature (320)..(320): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagacgcccaccctctcctgtgcggccagtcagagcgttaggacgtaacttgcctggtatcagcagaggcctggccaggctcccagacctcctcatcgtttggccgtccctttaacgngggtccagtcggaactccccgagccctaggttcaggccggcaggtcgggtcgtggggtacctttcggttacctacgtcctaccaccctattacctaaactaaccctgacctaattccgtcggaaccgtacttttcgacttagttttactttctgttcagtctagtccgtagaacgtaccgttcgggtcccgtttccgtaccggtttccggggaccggggtaacggggtaacccgtaaaggggttccggaacccgtacgaaaaccggtaacgttggtacggtccgtcgaccaacccgtattccgttcgttaccttccgtacttcccgttcccccgactctccgg

SEQ ID NO: 5253 - DNA, 645 bp, Homo sapiens
  misc_feature: GYAE6OF01C5YXE.8.28.C06.1.454.CMB.1.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
tcagctcgcgtgtccacgaccggtgctcgatttagagctcacgtattggggtttgggggaggaactgctcagttaggacccagacggaaccatggaacgccccagcgcagcttctcttcctcctgctactctggcctccagagatcagttggagaagtggtgatgacacagtcctccggtcacctgtcttgttttccgngggganagacgccctacctctccgtgtgcggccagtcaggagtcggtaggactaactgcctaggtatcagcgaggacggcgtggacgacggcctaccagcctcctnacttcgttcggccgttaccttaacgacgggcctaggtacggaactcccgacgaccgtaggtcgacggtcgcgtaggtcggtacgtcgggtacttcgtactacgtactactaaccataacgaaactaccgtgaactaactcctaggtaaccttagtttacgtaactttagtttacttcgtagtacagctagtactagaacgtgtcggtccgttacgtacggttcggacgggtaacgggtaccgtaaggtaccgaaccgtaacgaaaggtacgtggtacgaccgtacgacctacctgttccgtagttcccgtactaaccgttcccttacccgtctacggtcg

SEQ ID NO: 5254 - DNA, 880 bp, Homo sapiens
  misc_feature: GYAE6OF01DLHCH.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtctgtttttccgngggganagagcccaccctctcctgtgccggccagtcagagtcgtaggacgtaacttagcctggtactcagcagacggcctggccaggcctccagacctcctctattcgttttggaccgtccgtttaaacggacggggtaccctaggtacgggtaacctcccccgtaacgtaccccggtaggtttccgacgggtccggtaccgtacgggttcgggggttccgttacgggggttaacctttttccggggttaacctaaccgtttcccgttaccctaacccgtaaacttaaccctaaaaacgtttaaaccccgtggtaaccctaaacgttaccgttaaccggtaaccggttaacggtttttacggtacccgttttaaacggttttttaactttttccggtttacgttaccgtaacgggttaccgttaacggtttaccgttaacgggtaaacggtttaacccggttccggggtttaacccggttttaccgttaaccgggtttttacccggggaaccgggggttaacggggtaacccggttaaacgggggttaaccggtaccccgtaaacggtaaaacccggttaacggtacggggttacgggtaccgttaccggaccgtaacccggtctttaccggttcgttaccctttaccgttacgtttccccgtttaccccggtccctagttcccg

SEQ ID NO: 5255 - DNA, 725 bp, Homo sapiens
  misc_feature: GYAE6OF01EXNLZ.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgccctaccctctcctgtgcggccagtcagagtcggttaaggacgtaacttgctggtatcgagcgaggcggcctggaccgaggcctacccaggtaccctcctactacgttcgtttcggacccgttaccgtttaaaccggacgggtacccaagggtacggaaactccccgagtacccggtaggttccgacgggccggtcgtagggttcggggtccgtacggggttacctttccggttacctaccttccacctaccctaagttaccaaaacgttaccgtgtaacctaacgttccgttaccgtaacgttactttacgtacctttaaggttttacttcgttacgtactagtccgtacgttactaaggtaacgtcgtcgggtaccgtttcgtaccgggttcggggacggtaacgggtacgtaacgggtccgaaccgtacgaaacgttacgtcggtacgtacgtccgacgtacctagttcgtcggttaccttaccgttacttaccccgttcccgtacctgtaccg

SEQ ID NO: 5256 - DNA, 745 bp, Homo sapiens
  misc_feature: GYAE6OF01DTEP8.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctcccagagatcattggagaagtggtgatgacacagtctccggcaccctgtcttgttttccgngggganagacgccctaccctctcctggtcggccggccagtcaaggagtacgttaagggaactaacgttacgcgtggtacncgagcagaggtccnggccaggcctacccagtacctcctctattccgtttcggcgttacccgtttaacgaccggggtcctaaggtacggtaacctaccccgaacggtccgaaggtttccgaacgggcgggtacgtaagggttcggggttcgtacggggttactttccggttacctacctaccttaccaaacctaacttaactaaaacttaacccgtgaacctaactccgttaacgaaccgtttacgtttagtaccgtttaaagtttttactttcgtacggttacacgtaccgttacggtacttacggaaacgttacggtcggttacccgttcgttaccggttccgggacggggtaacggtaaaccggtaagggtacgtaaccgtaaccgaaaacggtaccgtaggtcggtacgtacgacctaccagttaccgtacttccgttactaccttaccgttccccatagtaccg

SEQ ID NO: 5257 - DNA, 705 bp, Homo sapiens
  misc_feature: GYAE6OF01AXXZ1.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggagagagccaccctctcctggtgcggccagtcagagcggttaggacgtaacttagccgtaggtactcagcaggaggcctggccaggcctcccgagtacctcctctacttcgtttcggccgttaccctttaacgacgggcctaggtcggaacctccccgaagcccgtaaggttcacggccggacgtacggtcggggtcgtcggggttacctttccggtttaccaccttcctaccaccgtaacttaccaaacttaaaccctgtacctaacttccgtacgtaaccgtacttttcgtacttagttttactttcgtgttacgagtcgtacgttcgtaggtaacgtacgttccgggttacccgtttacgttaccgggtttccgggacggggtaaccgggtaaccgttaagggtcgtaacccgtaagtaaaccggtacttagggtccggtacctcggacctacgtaccttcgtacgttacctttccacgttcccgttaccccgtcctacgttaccg

SEQ ID NO: 5258 - DNA, 577 bp, Homo sapiens
  misc_feature: GYAE6OF01BEA04.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
  modified_base (550)..(550): a, c, t, g, unknown or other
  misc_feature (550)..(550): n is a, c, g, or t
  modified_base (571)..(571): a, c, t, g, unknown or other
  misc_feature (571)..(571): n is a, c, g, or t
  modified_base (574)..(574): a, c, t, g, unknown or other
  misc_feature (574)..(574): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagacctcctcacttcgtttcgggccgtaccctttaacgacggggccctaggtcgggaaactccccgagccctaggttccaggccggcaggtcggggtctggggtacctttcgtcaccttcncaccntacaataaccngacaatctcgacgtactttgctagttttattctgtcagctagtctagaacgtaccgtcggtccgttctacgtttccgggcgggtaagggaccgaagggtcgacctacgaacgtactggtggctcgcactntctcgtcttcacttcctcccnctntcg

SEQ ID NO: 5259 - DNA, 679 bp, Homo sapiens
  misc_feature: GYAE6OF01BCSJ8.8.28.C06.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagagcccaccctctcctgtcgcggccagtcagngcgttaggacaacttgcctggtatcagcagaggcctggccaggcctcccagacctccgtctacttcgtttggccgtaccgtttaacgacgggtccaaggtcggaactccccgaagccgtaggttcaggcggctaggtggtctgggtacttcgtacactcacacatacaactaacctgacaatctacgacgtactttcgacttagttttacttcgtagtactagtaccgtagttcgtaagtaacgtacgttcgggtacccgtttacgtaccggtttaccgggaccggggtaacgggtaaccggttaaacgggtaccggtacccgtaacgtaaaacccgggtacttcgggttacggaccgtaccggtacccgaaccgttcgttacccgttcgtttacccgtttactaacccgtttcccccgttaccccggaccgttcgttacccgg

SEQ ID NO: 5260 - DNA, 658 bp, Homo sapiens
  misc_feature: GYAE6OF01C9LKE.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (265)..(265): a, c, t, g, unknown or other
  misc_feature (265)..(265): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcaccctgtctgttttccngggganagagccaccctctcctgtgcggccagtcagagcgttaggacgaacttagcctggtatcagcaagnggctggccaggctcccagactcctcatcgtttggcctcctttaacagggccagtggaactccagcctaggtcaggcggcaggtgggtctgggacttcggtcactctcaccatactaactaacctgacaatctagaacgtactttgacttagttttaattcgtgtaccaagtctaagtctaggtaaacgacgttcgggtccgtttacaccggttttcggggaaccggggtaacgggaacccgtaagggttccgggaacccttaacggaaaaccggtaacgttccgggttagggacccgttacgggaaccctaaacccgtacgttaccctttacgggttaccctttaccgtaaacctttccccgtttacccccgggaccttaacgttaaccccgg

SEQ ID NO: 5261 - DNA, 529 bp, Homo sapiens
  misc_feature: GYAE6OF01EV9G5.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagccaccctctcctgtgcggccagtcagagcgttaggacgaacttagcctggtatcagcagaggcctggccaggctcccagactcctcatctttggcgtcctttaacagggccagtggaatcccagccaggttcagcggcagtgggtctgggacttcgtcactctcaccatcaataacctgacaatctgacgtactttgctagtttattctgtcagcagtctagaagactgggccttcacgtttcgggcgggtagggaccgaagggtcgacctacgaaacgtaactggtaggctgcacatctgtcttcacttcctcccgctatcg

SEQ ID NO: 5262 - DNA, 622 bp, Homo sapiens
  misc_feature: GYAE6OF01A5HNU.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (576)..(576): a, c, t, g, unknown or other
  misc_feature (576)..(576): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccngggganagacgccaccctctcctgtgcggccagtcagagcgttaggacgtaacttagcctggtatcagcagaggcctggccaggcctcccgagacctcctcacttcgtttggccgtcctttaacgcgggccaggtgaactcccagcctaggttcaggcgcgaggtcgggtcgtgggtacttcgtctacgtctacacctatactaaataccctgactaatcgtagacgtactttgacttagttttattcgtagtacgagtctagtcgtagaacgtacgtcggtaccgttctaccggtttcgggacgggtaacgggtaccgtaagggtccggtaacctaacgaaaccggtaagttcgggtacggtaccgtcgtacccgaacctnttccgttacgttaccttacacctttacccgttcccgctacgtacgg

SEQ ID NO: 5263 - DNA, 782 bp, Homo sapiens
  misc_feature: GYAE6OF01DJA30.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttctgtttttccgngggganagacgcccacccttctcctggtcgccggaccagtcagacgcggttaggaactaacgttagccgtaggtatcgancggggggggganacggcctggcccaggcctaccgagtacctcctactacttcgtttcggccgttacctttaacggacgggtccaggtacggaactcccgagccgtacggttcacggcggcgtaggtcgggttcgtaggggttacctttcgttacctaccgttccttaccgaacctaacgtaacctaaacgttaacctcggaacttaacgttccgtacggtaacgtttccgtttaggtacttttaagttttacgtttcgttacggttacagtaccgttacgtaccggttaacggtaacggttaccgtccgggttaccgttttaaccgttaaccgggtttccggggaacggggtaacgggtaacccggtaagggttccgaacccgttaaccgaaaacggtcggttggtaccggggtacttaccggaaccttacccttcgttaccgtttacggtttaccctttaccgttaacccttcccccggtttaccccggacttcggttacccgg

SEQ ID NO: 5264 - DNA, 691 bp, Homo sapiens
  misc_feature: GYAE6OF01B1ZUW.8.28.C06.1.454.CMB.1.raw
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
  modified_base (264)..(264): a, c, t, g, unknown or other
  misc_feature (264)..(264): n is a, c, g, or t
tcagctcgcgtgtccacgaccggtgctcgatttagagctcacgtattggggtttggggggaggaactgctcagttacggacccagacggaaccatggaaggccccagcgcagcttctcttcctcctgctactctggctcccagagatcattgggagaaggtggtgatgacacagtctccggtcaccctgtctgtttttccngggganagagccaccctctcctgtgcggccagtcagagcgttaggacgaacttagcctggtancagcagaggcctggccaggcctcccagacctcctacattcgtttggccgtacccttttaaacgacgggtcccaaggtcgggaaaccttccccgaggacccgtaacgggttccaaggccgggacagggttgggggtcttacggggggtacccttttcgggtttacccaacttcccttacccgaaccctaattacctaaaattaacccccttagacctaacttccgtacggtaaccgtaccttttcgtactttaactttttaacttttctgttcctagtctagttctagaacgtacttcgggtccgttcgtaccgtttcgggacggggtacgggaaccgtaagggtacggaaccgtacgaaacgtacgtcggtaggtcgtcggaccaccgtatcgttcgtacttctacttcctccccgtcgtactaccg

SEQ ID NO: 5265 - DNA, 606 bp, Homo sapiens
  misc_feature: GYAE6OF01A7IY6.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagcccaccctctcctgtgcggccagtcagagcgttaggacgaacttagcctggtatcagcagaggcctggccaggcctcccagacctcctcattctttggccgtcctttaacgcggggtccaggtcggaactccccgagcccgtaggttcaggccggcaggtgggtcgtggggtacctttcggttccactctacaccatacaactacctgacaatctagacgtactttgacttagttttattcgtgtcagtctagtctagaacgtacgtcgggtacccgttcgtaccggtttcgggacgggtaacgggtaccgtaagggtacgaccctacgaaaccggtacgtggtacggcgtcgaccactctccgttgttcccttctaccttcccttccccgcctagtacccg

SEQ ID NO: 5266 - DNA, 834 bp, Homo sapiens
  misc_feature: GYAE6OF01ASR63.8.28.C06.1.454.CMB.1.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggcctcccagacctcctcattcgtttcggccgtacccgtttaacgcggggtccctaggtacgggaaaccttcccccgaaggtccccgtaagggtttccgaacgggtcccgggtacgtaacggggtttcgggggttccgttacggggggttaacccttttccgggtttacctaacccgtttccgttacccctaaccccgtaacgttaacccgtaaaaacgtttaaaaccccgttggtaaccttaaaacgttcccgttacggtaaacccggttacgtttttacggtacgtttaaaggttttttacttttccgttagttacccgtaggtcctaacggttacgtaacggtaaacggtaccgttcgggttacccgtttaccgttaaccggtttccggggacggggtaccggggtaacctaacggggttaccgaacccgtaaccgtaaaaccggtaacgttcgggttacggacccgtcggtaccctaacccgttcgttacccgttacgttacccgtttacctaacccgtttcccccggttaccccgtacccgttgttaaccccgg

SEQ ID NO: 5267 - DNA, 826 bp, Homo sapiens
  misc_feature: GYAE6OF01D1VDD.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccaccctctcctgtgccggccagtcagagtcgttaggactaacttagccgtggtatcagcagacggcctggccaggcctcccgagtacctcctctacttcgtttcggccgtacctttaacggacgggtccctaaggtacggaacttccccgaacgtaccgtaggttaccgaaggtccggacgtaggtcggggttacgttacgggggtaccttttcgggttaccaaccgtttcctaccgtaacccgtaatacccgtaaaacttaaacccgttggaacctaaacttccgttaacggtaacccggttaactttttcggtaaccgtttaacggtttttaactttccgtttacggttacgtaaccggttacgttaacggtttacgtaacggttaaccggtacgttaccgggttcccgttttaacgtaacccgggtttccggggaccggggtaaaccggggtaacccggttaaagggtacccggtaaccgtaaaccggtaaaacggttaccggttacggtaccggtaccgtccggtaacccgtaccgttaccgtttacgttcccgtttaacccgtttccttaacccgtttccccgtttaccccgtacgttaaccggttacccgg

SEQ ID NO: 5268 - DNA, 623 bp, Homo sapiens
  misc_feature: GYAE6OF01EPT6R.8.28.C06.1.454.CMB.1.raw
  modified_base (199)..(199): a, c, t, g, unknown or other
  misc_feature (199)..(199): n is a, c, g, or t
  modified_base (403)..(403): a, c, t, g, unknown or other
  misc_feature (403)..(403): n is a, c, g, or t
tcagctcgcgtgtccacgaccggtgctcgatttagagctcacgtattggggtttggggggaggaactgctcagttaggacccagacggaaccatggaagccccagcgcagcttctcttcctcctgctactctggctcccagagatcattggagaagtggtgatgacacagtctccggtcaccctgtcttgtttttccgngggggagagacgcccaccctctccgtgtcggcggccagtcaggagcgttaggacgtaacttagcctggtatcgagcagacggcctggccagggcctcccagacctcctctatcgtttgggccgtacctttaacgcggggccaggtcggaactccccgagtccgtaggttcaggcggcaggtcgggtctgggacttcgtcactcncacatacaactacctgactatctacgactactttgacttagtttattcgtgtcagtctagttctaggaacgtacgttggtccgttcgtaccggtttccggggcggggtaacgggtaccgtaagggtcgtaaccgtaacgaaaacggtacttcgggtaggccgtcgaccacccgtagttccgttcgttacttctacttcccgttccccgtctacgttaccg

SEQ ID NO: 5269 - DNA, 888 bp, Homo sapiens
  misc_feature: GYAE6OF01BMWII.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccaccctctcctgtgcggccagtcagagtcgttaggactacttagcctggtatcagcagacggcctggccaggcctacccagtacctcctacatttcgtttcgggccgttaccgtttaaacgacggggtcccaggtcggaaaccttccccgagtaccccgtagggtttccaacgggtccgggacgtaggggttcgggggtccgttacgggggtactttccggttaccgtacctttcctacccgtaacccaacgtttacctaaaaccgttaaacccgtggtacccttaaatcccggttacggtaaccggttacgtttttacgggtacctttaaggttttttactttacgtttaccggttacgtaaccggtccgttaaggtttcccgttaacgggaaacggtttacccgtttaccgggggttaccccgtttttaaccgggtacccgggtttttaaccccgggggaacggggggttaaacccgggggtaccccggtttaaacggggggtcccggttaaaccccgttaaaacccgggtaaaaccgggttaaccggtttaccggggttaccgggtaccggttacccggtacccttaacccggtaaccgtttcccgttaacggttttcccgttaccgtttaaccctttcccccggtttacccccggtaaccttcggtttaacccgg

SEQ ID NO: 5270 - DNA, 676 bp, Homo sapiens
  misc_feature: GYAE6OF01CEXXQ.8.28.C06.1.454.CMB.1.raw
  modified_base (513)..(513): a, c, t, g, unknown or other
  misc_feature (513)..(513): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgttttccgtggggagagacgcccacctctcctgtcgcgccagtcaggagtacgttaggacgaacttagccgtaggtatcgagccgaaggacggtccgtcggccgacggtcctacccgagtacctcctactacgtttcgtttcggaccgttacctttaacggacgggtccctaaggtacggaacctccccgacgtaccgtacggttcacggtcggaccgtaggttcgggtcgttggggacctttacggttacactcgtaccaactactactaaacgttactgaactatccgtagtaccttacgtttgtacgtttagttttattccgtnttcagtcctagtcctagactagtcgttccgtcgtaccgttcgggacgggtaacggtacgaagggttaccgaccgtacggaaacgtccgtaggtacgccgtacggactaaccggtcttccgttaagttccttacgtaccttcccgtaccccgtccttagtcccg

SEQ ID NO: 5271 - DNA, 766 bp, Homo sapiens
  misc_feature: GYAE6OF01CYIKX.8.28.C06.1.454.CMB.1.raw
  modified_base (197)..(197): a, c, t, g, unknown or other
  misc_feature (197)..(197): n is a, c, g, or t
  modified_base (759)..(759): a, c, t, g, unknown or other
  misc_feature (759)..(759): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgtcttgttttccgnggggagagacgccacctctcctgtcgccggccagtcagacgtcgttaggacgtaacttacgccgtaggtactcgaggcaaggacggccgtacggaccacggtcctacccgagtacctcctacgtacgttccggtttcggaccgttacccgtttaaacggcggggtacctaagggttacggaaaaccgttccccgaaggtacccggtagggttaccgacggggtaccgggtacggtacgggtttcggggtccggttacgggggttaccctttttaccgggttccgtaacccttccgttaacccgtaaacccgttaaacgttaaaccctaaaacggtttaacccctaggtaacccttaacgttaccgttacgggtaaccgttacgttttacgacgttttacgttttaacgtttcgtacgtacgtaacgtctacgttacgtaggtaaccgtcgttacgtaccgttacgtacggttacgggacggtaacggaacgtacggtacgacgtacgaaacgtcgcggtagcgtcgactactgttacgtcgttacctctaccgtccgtcccnctgtacg

SEQ ID NO: 5272 - DNA, 509 bp, Homo sapiens
  misc_feature: GYAE6OF01AUZSS.8.28.C06.1.454.CMB.1.raw
  modified_base (311)..(311): a, c, t, g, unknown or other
  misc_feature (311)..(311): n is a, c, g, or t
  modified_base (487)..(487): a, c, t, g, unknown or other
  misc_feature (487)..(487): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaaacngggccagtggaatcccagccaggttcagcgcagtgggtctgggacttcgtcactctcacatcaataacctgcaatctgacgtactttgctagtttattctgtcagcagtctagaagactggccttcactttcggacggtagggaccaaggtcgacctcaaacgactgtgctgcacntctgtctcatcctccnctntcg

SEQ ID NO: 5273 - DNA, 812 bp, Homo sapiens
  misc_feature: GYAE6OF01DRXVZ.8.28.C06.1.454.CMB.1.raw
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
tcagctcgcgtgtccacgaccggtgctcgatttagagctcacgtattggggtttgggggaggaactgctcagttaggacccagacggaaccatggaacgccccagcgcagcttctcttcctcctgctactctggcctccagagactcagttggagaaggtggtgatcgacactacgtcctccggtccaccttgttctttcggtttttccggnggggaanacgacgccctacccgtctccgtggtcgaccggtcaggtcgaggtacggtacggttaacggaacgttaaccgttacggtcccggttaggtactacggacggtacgacgggaccggtcccgtcgggaccgtaccggtcctacccgacgtcctaccgtcttacgttccggtttcgaccgttaaccgttaacggcgggtaccgtaggtaccgaacctccgacggtaccgtacggtacgacgggtcggaccgttgggttaccggtcggttcgggttacctttcgtaccctacttcccgtacgtaaaccctacgttaaccttaaaccgtacgttacgaaccgttacttccggtaacggttaaccgtttacgtttaccgtagttttaacgttttcgttcgtacgtacgtacgtacgtacggtacgttaacgacggttccggttccgttacgttccggttaccggtacggggtaaccggtaacggggtaactacgggtaaccgtaaccaaaccggttaaggtcggtacggtacgtacgtacccggactacgttcttacgttcttaaccctctacccgttcccacccgttataaccgtccgg

SEQ ID NO: 5274 - DNA, 529 bp, Homo sapiens
  misc_feature: GYAE6OF01CWKLS.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (256)..(256): a, c, t, g, unknown or other
  misc_feature (256)..(256): n is a, c, g, or t
  modified_base (416)..(416): a, c, t, g, unknown or other
  misc_feature (416)..(416): n is a, c, g, or t
  modified_base (501)..(501): a, c, t, g, unknown or other
  misc_feature (501)..(501): n is a, c, g, or t
  modified_base (522)..(522): a, c, t, g, unknown or other
  misc_feature (522)..(522): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaacttgcctggtancagcagaggcctggccaggctccagactcctcatcgtttggcgtcctttaacgagggccaggtggaactcccagccaggttcagcggcaggtgggtctgggacttcgtcactctcacatcaatacctgcaatctgacgtactttgctagtttattctgtnagcagtctagaacacgtgtccgttcacgtttcgggcgggaggaccgaagggtcgacctacgaaacgactggtcggcgtcgcaccntcctgtcttcactccttcccncctgtcg

SEQ ID NO: 5275 - DNA, 896 bp, Homo sapiens
  misc_feature: GYAE6OF01ETWKP.8.28.C06.1.454.CMB.1.raw
  modified_base (198)..(198): a, c, t, g, unknown or other
  misc_feature (198)..(198): n is a, c, g, or t
  modified_base (264)..(264): a, c, t, g, unknown or other
  misc_feature (264)..(264): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgcccaccctctcctggtcgcggccagtcagagcgttaggacaacttagcctggtancagcagaggcctggccaggcctacccagacctcctactattcgtttcgggccgtacccgttttaaaccgacgggggtaccctaaggtacgggaaaccttcccccgaacggtccccgtaacgggtttaccgaacgggtcccggggacgtaacgggttcgggggttccggttacggggggttaacccttttccgggtttacccgtaacccgtttcccgttacccgtaaaccccctaaactttaaccctaaaacctttaaaacccgttcggtaaaccttaaacgttacccggttaccggtaaaccggtttaaccgtttttacggtaccgtttaacggttttttaactttttacgttacggttaacgtacggtaccgttaggtttaccgtaacgggtaaacgttacccggttccgggttaccccggttttaccgttaaccgggttttacccgggggaccgggggttaaaccggggtaacccggtaaacgggggttacccgggtaaacccttaaccggtaaaaaccggtaacggtttaccggtcgggtaccgtaccggtaaccctaaccgtaacgttccgtttacgttacccgtttaccgttaccttccccgtttaccccgccttaaccgttaccgg

SEQ ID NO: 5276 - DNA, 595 bp, Homo sapiens
  misc_feature: GYAE6OF01EO424.8.28.C06.1.454.CMB.1.raw
  modified_base (197)..(197): a, c, t, g, unknown or other
  misc_feature (197)..(197): n is a, c, g, or t
  modified_base (406)..(406): a, c, t, g, unknown or other
  misc_feature (406)..(406): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagacgcccaccctctcctgtgcggccagtcagagcgttaggacgaacttagcctggtactcagcaggacggcctggccaggcctacccgagacctcctctacttcgtttggccgttacctttaacgacggggccaggtacggaactcccagcctaggttcgagcggcgtaggttggttcgtgggtacttcgtcactctcaccntaccaatacctgactaatctacgacgtctttcgtacttagttttacttctgtcagtcgtagttctaggacgtaccgtcggtccgttactacggttcggacgggtacggaccgaggtccgacctacgaaacgtgtgaggcgtcgacacctcttcgttcgtacttcgtacttcccgtcccgctctacccgg

SEQ ID NO: 5277 - DNA, 567 bp, Homo sapiens
  misc_feature: GYAE6OF01BAZYC.8.28.C06.1.454.CMB.1.raw
  modified_base (422)..(422): a, c, t, g, unknown or other
  misc_feature (422)..(422): n is a, c, g, or t
  modified_base (560)..(560): a, c, t, g, unknown or other
  misc_feature (560)..(560): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccgtggggagagagccaccctctcctgtgcggccagtcagagcgttaggacaacttagcctggtatcagcagaggcctggccaggctcccagactcctcatctttggcgtcctttaacgcggccagtcggaatcccagccaggttcagcggcgtagtgggtctgggtacttcgtcacgtctcaccgatctaaatacctgacaactctacgactacttgctagtttattctntcagtctagtcgtgaagtccgtggtaccgttactaccgtttcggacggtacgggaacctaagggtcgaccgttacaaacggtactggcggtacgtcgacacctatccgttatcctttacgacttccttaccccgcgtnttaccgg

SEQ ID NO: 5278 - DNA, 548 bp, Homo sapiens
  misc_feature: GYAE6OF01E0N0S.8.28.C06.1.454.CMB.1.raw
  modified_base (195)..(195): a, c, t, g, unknown or other
  misc_feature (195)..(195): n is a, c, g, or t
  modified_base (311)..(311): a, c, t, g, unknown or other
  misc_feature (311)..(311): n is a, c, g, or t
  modified_base (518)..(518): a, c, t, g, unknown or other
  misc_feature (518)..(518): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggctcctttaacgngggccagtggaactcccagccaggttcagcgcagtggtctggggacttcgtcactctcaccatcaataacctgacaatctagacgtactttgcttaagtttatttctcgtctagcagttctagaagtctgggtccgttcgtacgtttcgggacgggtagggaccgaaggtcggaacctacgaaacgtactggtggcgtgacaccgtntctgtcttcacttcccttcccgcctatccg

SEQ ID NO: 5279 - DNA, 863 bp, Homo sapiens
  misc_feature: GYAE6OF01BS40C.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacaaacttgcctggtatcagcagacggcctggccaggcctacccagacctcctctacttcgtttcgggccgtaccgttttaaaccggacggggtcccaggttacgggaaccttccccgaaggtcccgtaagggtttccgaacggtccggggtaccgtaacggggtttcggggggttaccgttacgggggggttaaccttttccgggtttacccgtaaaccccgtttccgttaaccccggaaaccccgttaacgttaacccctaaaaacgtttaaacccccgttgggtaacccttaaaaccgtttcccggttaacgggtaaccggtttaaccgttttacgggtacccgtttaaaggtttttttacctttacgttacggttaccgtacggtaccgtaacgtttaccgtaaggtaaccgttaccggttcgggttacccgtttaccgttaccggtttaccggggaccgggtaacgggtaaccgtaaacgggtaccggtaacccttaaccggaaaaccggttacgttcggacggttacccgtacggtaccctaacccgtacgtttaccgttacggtttacccttaccgttaccgtttaccccgttaccccgtaccgtagtttaccccgg

SEQ ID NO: 5280 - DNA, 783 bp, Homo sapiens
  misc_feature: GYAE6OF01EPRHG.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagacgccaccctctcctgtgcggccagtcagagcgttaggacgtaacttagcctggtatcgagcgaggacggtccgtcggccgaggcctcccgagtacctcctctacttcgtttcgggccgtacctttaacggacggggcccgtaggtcggaactccccgagtcccgtaggttaccgacggtccggacgtaggttcggggtccgttacgggggtaacctttcgggttacctaccgttacctacccgaacccctacttaccgaaacttaacccgtaggaacctaacgttccgttacggtaaccgttacgttttcgtacttaggtttttaactttcgtacggttacgacgtactacggtttacgtacggtaaacggttccggttacgggttacccgtttacgttaccgggttttaccggggaccgggggtaaacgggtaacccggtaaaggggttccgtaaacccgttaccggtaaaaccgggtaccgttgggttaccggtaccgttacgaccctaaccgttccgttcgtttaccggttcctttaccgtaccttccccgtttaccccggccttacgtacccgg

SEQ ID NO: 5281 - DNA, 835 bp, Homo sapiens
  misc_feature: GYAE6OF01BGYVJ.8.28.C06.1.454.CMB.1.raw
  modified_base (194)..(194): a, c, t, g, unknown or other
  misc_feature (194)..(194): n is a, c, g, or t
  modified_base (259)..(259): a, c, t, g, unknown or other
  misc_feature (259)..(259): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcacctgtcttgttttccgngggagagacgccacctctcctgtgcggccagtcagagtcgttaggacgtaacgtagccgtggtancgagcagacggcctggccgacggcctacccgagaccttcctctacgttcgtttcgggaccttaccgtttaaacgacggggtaccaggttacggaacctccccgaaggtcccgtaagggtttccgacgggccgggtacgtacggggttcggggttaccgttacgggggttacccttttaccggttaccaaccgttccgtaacccgaaaccctacttaaccgtaaaaaccttacccgtaggtaaccttaacgttccgttaacgtaaccgttacgttttacgtaacgtttaacgtttttacgtttacgtacgttaccgtaacggtacgttacgtttacgtaacggtaacgttaccggttccgggttacccgtttacgttaccggtttaccgggggaaccggggttaaccgggtaaccggttaacggggttaccggtaaccccgttaacggtaaaaccgggtaccgtttgggtaccggtaccgtaccggacccgtaacccgttaggttccccgtttacggttacccgttttaaccgtacccgttttaccccggttacccccgtacgttaaccgttaccgg

SEQ ID NO: 5282 - DNA, 653 bp, Homo sapiens
  misc_feature: GYAE6OF01ET8HC.8.28.C06.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (532)..(532): a, c, t, g, unknown or other
  misc_feature (532)..(532): n is a, c, g, or t
  modified_base (646)..(646): a, c, t, g, unknown or other
  misc_feature (646)..(646): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggagagngccacctctcctgtgcggccagtcagagtcgttaggacgaacttagccttaggtatcagcgagaggcctgggccaggcctacccagacctcctcattcgtttggcgtcctttaacgcgggccaggtggaactcccgagccgacggttcaggtccggctaggtgggtcgtggggtacctttcggttcaccttcgtaccaccgactaccaaactaacccgtgactaagtcttacggacgtactttggtacttaagttttacttcgttcgtactacgtctacgttcgtaggtaacgaccgttcgggtacccgtttcgtaccgtttaccggggngggtaaaccggggaccgtaaacgggtcggtaaccgtaacgaaacggttacgtcggtacggtaccgtgaccgtacctgttcgttacgttccttactacttcccgtcccgtccgtnttacccg

SEQ ID NO: 5283 - DNA, 604 bp, Homo sapiens
  misc_feature: GYAE6OF01BEPRD.8.28.C06.1.454.CMB.1.raw
  modified_base (202)..(202): a, c, t, g, unknown or other
  misc_feature (202)..(202): n is a, c, g, or t
  modified_base (374)..(374): a, c, t, g, unknown or other
  misc_feature (374)..(374): n is a, c, g, or t
  modified_base (426)..(426): a, c, t, g, unknown or other
  misc_feature (426)..(426): n is a, c, g, or t
  modified_base (559)..(559): a, c, t, g, unknown or other
  misc_feature (559)..(559): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggganagagccaccctctcctgtgcgccagtcagagcgttaggacgaacttgcctggtatcagcagaggcctggccaggctcccagactcctcatctttggctcctttaacagggccagtcggaatcccagccaggttcagcggcaggtgggtctgggacttcgtcactctctaccnttacaaataaccctgactaattcgtagaacgtactttcgacttaaggttttntttcgtcgttcacgtctacgtctaggtaacgtacctcgggtccgttcgtccgtttcggggacgggtacgggaacctaagggtacggtaccctaacgaaacggtaacgtcggtacggacgtcgaccaacccgtnttccgttcgttactttccaacttcccttcccccgacgtcttaccg

SEQ ID NO: 5284 - DNA, 731 bp, Homo sapiens
  misc_feature: GYAE6OF01DZLIZ.8.28.C06.1.454.CMB.1.raw
  modified_base (198)..(198): a, c, t, g, unknown or other
  misc_feature (198)..(198): n is a, c, g, or t
  modified_base (265)..(265): a, c, t, g, unknown or other
  misc_feature (265)..(265): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggggagagagccctaccctctcctgtgcggccagtcagagtcgttaggacgtaacttgcctggtancagcaggacggcctggccacggcctcccacgacctccctcacttcgtttcgggccgtacctttaaacggacggggaccaggtaggaacctcccgacgaccgtacgggttacacggcggacgtagggtcgggtacgtggggtacctttcggttactactcctacgaacctagtacctaaacttaaccgtcgtactaacttcgtacggtaccgttactttcgtacgttagttttaacttcgttacgttacgtacgtacgtagttcgtaaggtaacgtacgttcgggttaccgtttaccgttacggtttaccgggaccggggtaacgggtaaccgtaaggggttaccgtaaccgtaaccgaaaccggtacgttcggtacgggtaccgtacggtaccctaaacgttcgttaccgtttcggttaccctttacgaaccgtttaccccgttccccggtcctaccgttaaccgg

SEQ ID NO: 5285 - DNA, 732 bp, Homo sapiens
  misc_feature: GYAE6OF01BQ931.8.28.C06.1.454.CMB.1.raw
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (336)..(336): a, c, t, g, unknown or other
  misc_feature (336)..(336): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctccagagatcattggagaagtggtgatgacacagtctccggtcacctgtcttgttttcgngggganagacgccaccctctcctgtcgcgccagtcagagtcggttaggacgtaacttagccgtggtactcgagcgaaggacggccgtggccacggtctacccagtacctcctctatttcgtttcggccgttaccgtttaacggngggcctaggtcggaacctccgaagtccgtaggtcgaggcggactaggtcgggttcgtagggttaccttcgttacaccttcgtacctaacctaactaacctaaacttaaccgtagacttaacgtcgtacggtaacgtaccttttgtactttaagttttcttacgtcgtacgtagtactacgttcgtaacgtaacggtaccgttcgggttcccgtttacgtaacgggtttccggggaccgggtaacgggaaccggttaagggtaccggtaaacctaaccgtaaaaccgggtacggttacggtacggtaccgtaccgtacctaacccttagtttcccgttacgtttccccgttaacctttacggttacccccttcccgtaaccccgttaggttacccgg

SEQ ID NO: 5286 - DNA, 622 bp, Homo sapiens
  misc_feature: GYAE6OF01EA0HQ.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (319)..(319): a, c, t, g, unknown or other
  misc_feature (319)..(319): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacaacttagcctggtatcagcagaggcctggccaggcctacccagacctcctctattccgtttgggacctcctttaacgngggtccaggtggaactcccagtcctaggttcacggcgcgaggtcgggtctgggtacttcgtcacttctacacctatacaactacctgactaatcctagacgtactttgcttagtttactttcgtgtactagtctagtctaggaacgtcgttacgggtccttacgtaccggtttcgggacgggtaacgggaaccgtagggttaccggaccttaacgaaaaccggtacgttaggtacggccgttagacccgtacctacgttacttcggtaccttcctacttccccgtttccccgcctcgttaccg

SEQ ID NO: 5287 - DNA, 647 bp, Homo sapiens
  misc_feature: GYAE6OF01A1VH5.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtcctccggtcacctgtcttgttttccgngggganagacgccaccctctcctgtgcggccagtcaggagcgtagacgaatgctgtatcagcagnggcctggccaggcctccagcctcctcacttcgtttcggccgtaccttaacgcgggacctaggtcggaacctcccgaagtccgtacggttcgaggccggacaggtcgggtctggggtacctttcgtcacgtcctctacctataccgtaaactaccctggacctaagttcgtacgtaaccgttacttaggtcctttaagttttacttcgtacgtcgtaacgtcgttaagtacttacggaagtaccgttcgggttacccgtacgttacggttccggggacggtaccgggtaaccgaacggtacgtaaccgtaaccgaacgtagtacggtcgaccgtacggcctaccttgtccttaggttccttactccggttcctacccgtctaacgtcg

SEQ ID NO: 5288 - DNA, 870 bp, Homo sapiens
  misc_feature: GYAE6OF01DMZ5A.8.28.C06.1.454.CMB.1.raw
  modified_base (832)..(832): a, c, t, g, unknown or other
  misc_feature (832)..(832): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagtttcagataccaccggagagattgtgttgacacagtctccagccaccctgtctttgctccgaggggaaagacgccaccctctcctgcagggccagtcagtaatgttggccgtccttacgtaagcttcggtaacccaaacgaaccaaaccgtggaccagggtcctacccgaccggtccccctacactccgttaagtcgggtcacctaactcccaaaccgacggggacccaacgtcgggctaaccgtccccgaagacccgtacggttcgaacggttcggccgtaagggtggggtacgtagggggtacaacgtaaccgttcctaccttccttaccgaccctattacaacttccgagtacccggttgggaaccgtacccgttaaggtaaaggtacgttcggtttacgtacgttaaggtttttaactttaacggttcgttaacctaaacgttaaccgttaccgggtaaccccggtagggttacccggggtcccccggggtttaccccggggggtaaccccttaaccgggttttttccccggggaccccggttaacggggggtaaaacccggttaaacgggggttaccgggggtaaaaccggtaaacgtttaaaacccggaaaaaccgggttaaccgttacgggggtttacccgggaacctttacccggggaacccctaaccggttaaacccgggtttntttaccccgggtttacctttaacccgtttaacccccgg

SEQ ID NO: 5289 - DNA, 758 bp, Homo sapiens
  misc_feature: GYAE6OF01CQHAU.8.28.C06.1.454.CMB.1.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (330)..(330): a, c, t, g, unknown or other
  misc_feature (330)..(330): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggganagacgcccaccctctcccgtgtacggccggccaggtaccaaggcgaccggttaaagggaaccgtaacttacggccgttggtactacgagcaaggcggcctggccacggcctccgaagtacctcctntattcgtttacgggccttaccttaaacggacggcctaggtacggaactccccgagtacccgtaggttccagggccggagtagggttcgggtaccgtaggggtactttccgtactacctctaccgacctatacctaaacttaccgtagtactaacgttcgtacggtaaccgttacgtttcggaactttacgttttactttcgtacgttacacggttactacgtacgtaggtaacggtaccgttaccgggtaccctttacgtaaccgggtttccgggaaccggggtacgggtaaccgttaagggtaccgtaacccggttaaccaaacggtaaccgttggtacgggtaccgtaccggtactaacccgttgttaccgttcgtttaccgttaccgtaccgtttccccgttaccccgacgttccgttaaccggg

SEQ ID NO: 5290 - DNA, 654 bp, Homo sapiens
  misc_feature: GYAE6OF01D284Y.8.28.C06.1.454.CMB.1.raw
  modified_base (198)..(198): a, c, t, g, unknown or other
  misc_feature (198)..(198): n is a, c, g, or t
  modified_base (261)..(261): a, c, t, g, unknown or other
  misc_feature (261)..(261): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgttcttgttttccgnggggagagacgccaccctctcctgtcgcggcagtcagagtcgtaaggactaactacgctgtancagcaggcgcctggccaggcctaccagtacctcctctattcgttggcctaccttaacggcggcctaggtacgactcccgaagtccgtaggtcgacggtcggagtacgggtcgggtcgtagggtacctttcggtacaccttcacacctataacaactacctgactaagtctagtaccttacgttacgtactttatttacgttcgtacgtacgtacgtctagtacgtaggaacgttcgtccgtcgttacgttaccgggttacgggacgggtaaccggtaaccggtacggtaccggtaaccgtaaacgaacggttacggtgtaccggtactccgggacctaccgtcgtcccgttagttcccttactacccttaccccgtccctacgtacgtaccgg

SEQ ID NO: 5291 - DNA, 586 bp, Homo sapiens
  misc_feature: GYAE6OF01DKOC3.8.28.C06.1.454.CMB.1.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcaggacggcctggccaggcctcccagactcctcattctttggcgtcctttaacgaggggcccaggtcggaactccccagccgtaggtcagcgcagtgggctgggacttcgtcactctcacctatactaatacctgacaatctagacgtactttgactagtttattcgtgtacagtctagtctgaacgtacgtcggtccgtttcgtacgttttggcgggtacgggtaaccgtaagggtacggtaccgtaacgaaaccgtaacgtggtacggcgtcgaccacctactccttcgtacctttccgacttcccgttccccgtcctactcg

SEQ ID NO: 5292 - DNA, 600 bp, Homo sapiens
  misc_feature: GYAE6OF01AUSBS.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagacgccaccctctcctgtgcggccagtcagagcgttaggacgtaacttagcctggtatcagcaggacggcctggccaggcctcccagacctcctcattcgtttcggccgtacctttaacgacgggcctaggtcggaactcccgagtccgaggttcaggcggcgtaggtgggtctgggtactttcgtacactctaccgaccataccaaactacctgactaactctagtacgtacgtttcgacttagtttacttctagtcagtctagtcgtagtaacgtacgtcggtccgttcgtacgttcgggacgggtacgggaaccgtaagggtcgaacctacgaaacgtacgtggtcggacgtcgaccactgtccgtgttcctactacttaccctcccgctgtccg

SEQ ID NO: 5293 - DNA, 642 bp, Homo sapiens
  misc_feature: GYAE6OF01D3ZX4.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagacgccaccctctcctgtgcggccagtcagagtcgttaggacgtaacttagccgtggtatcagcagaggcctggccaggcctcccagacctcctctattcgtttgggccgtaccctttaacgaggggacccaaggttcgggaaactccccgagcccgaggttccaggcggcaggtgggtctgggtacttcggtcacgtctcaccataccaaattacctgactaactcgtacgtaacgtactttacgcttagtttactttcgtgttcagtctagtctagaacgtacgtcggtcccgttcgtaccgtttccgggacgggtacggtaaccgtaagggcggaccctaacgaaaaccgtacgttcggtcggtccgtacggaccctacctacgttccgtacgttaccctttccaacctttcccgttcccccgtccgtagttacccg

SEQ ID NO: 5294 - DNA, 656 bp, Homo sapiens
  misc_feature: GYAE6OF01A3EK4.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagtcaggaggcctggcccaggcctcccgagacctccctcacttccgtttggccgtcccttttaaacgacggggtccaggttacgggaacttccccgagcccgtaaggttcaggccggcgaggtcgggttcgtcggggtacctttcgttccaacttccgaccacctatacctaaactaacctgacctaacttcgtacgtaccgtactttgacttagttttattctgtctagtactagtctagtaacgtcgtggtcccgttagtaccgtttacgggaccgggtacgggtacgtaacgggtacgtaaccgtacgtaaacggtaccgttaggtaccgggtctacggacctaacggtacttcgttacgttccttacgtacttaccctcccgtctacgtaccg

SEQ ID NO: 5295 - DNA, 771 bp, Homo sapiens
  misc_feature: GYAE6OF01CTCJ9.8.28.C06.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
tcagctcgcgtgtccacgaccggtgctcgatttagagctcacgtattggggtttgggggaggaaccgctcagttaggacccagacggaaccatggaagccccagcgcagcttctcttcctcctgctactctggctccagagatcattggagaagtggtgatgacacagtcctccggtcaccctgtcttcgttttccgngggganacgcgcccacctctccgtgtcggccggacacgtccaaggagtacggttaacggaacgtaaactttacggccgttagggtatccgaagtcgaacggacggtccggaggcccgaacgggtccctacccgaggtaacctcctacgtaactttcgttacgaccttaaccgttacgacgggtacccagttacggactcccaggtccgtaaggtcacggtcggcgtaggttcggtacgcgggttactcgtacactctacaacgtactaacaaacgtaacgtcaacactcgtaacgtactacgtttacgacttagtttacttctacgtcgagtcgtagtacgtacgtaacgtcgtacggttaccgtacgtaaccgttcggggacgggtaaacgggtaccggtaaacggggttactaaacccggttacgaaaaaccggttacggttacgggtaacgggttccgtaacggaacccgttaacggttacttccggtttacccggttaccttttaacccgtaacccggtttacccccgttaaccccgtaaccggtaccgtttaaccgggtaaaccgggg

SEQ ID NO: 5296 - DNA, 776 bp, Homo sapiens
  misc_feature: GYAE6OF01CLUJK.8.28.C06.1.454.CMB.1.raw
  modified_base (440)..(440): a, c, t, g, unknown or other
  misc_feature (440)..(440): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagacgcccaccctctcctggtgcggccagtcaggagtcggttaggacgtaacgttagccgtggtatcgagcgagacggcctggccaggcctacccgagtacctcctctacttcgtttggccgtaccctttaaacgcgggcctaaggtcggaactcccgagtaccgtaggttcaggcggtcgtggtcgggtctggggtacctttcgtactctactcgacctagtactaaacgttaccngtactaacgttcgtacggtaaccgttacgtttcgaacgttttagttttaactttcgttacggtacgtacgtacgtaacggtttacgtaccggtaaaacggttccgtttccggggtttcccgttttaccccggttaacgggtttttcccgggggaacggggtacccgggggttaaacccggtaagggggttaacccgtacccgtaaaccggtaaaacccgggttacggttacgggttaccgggtaccgtttccggacccgttaaccgtacgttccgttacggtttaccctttaccgttacccttccccggttaccccggcccgttcgtttacccggg

SEQ ID NO: 5297 - DNA, 686 bp, Homo sapiens
  misc_feature: GYAE6OF01CRHUS.8.28.C06.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (256)..(257): a, c, t, g, unknown or other
  misc_feature (256)..(257): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctccagagatcaagttggagaagtggtgatgacacagtctccggtcaccctgtctgtttttccngggganagacgccacctctctgcgcgcagtcagngtcggtaggactaattgctggtannagcaggacggctgccaggcctccaancctcntatcgtttgcctacttaacgcggccaaggtgaactcccgagtcaggttcagcggcaggtgggtcttggggacctttcgctacgtctaccgtacagttacaaacgttaaccgtgacctaattacgtaggtaaccgttacgttcgactttaaggttttacttcggtacgtacctaacggtactacgttaccgtaagtaaacgtacgttcgggtacccgtttacgtaacccgggtttcgggaaccggggaacgggtaacccgtaagggttacccggaacccgttaacggaaaaccggttaacgcggtttaggaccccgtcgtaacccgacgttaaccttcccgttaacggttccctttaccgtaaccgttaccccgttaccccgtacgttacgtaaccggg

SEQ ID NO: 5298 - DNA, 605 bp, Homo sapiens
  misc_feature: GYAE6OF01ERHF1.8.28.C06.1.454.CMB.1.raw
  modified_base (198)..(198): a, c, t, g, unknown or other
  misc_feature (198)..(198): n is a, c, g, or t
  modified_base (400)..(400): a, c, t, g, unknown or other
  misc_feature (400)..(400): n is a, c, g, or t
  modified_base (428)..(428): a, c, t, g, unknown or other
  misc_feature (428)..(428): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
  modified_base (474)..(474): a, c, t, g, unknown or other
  misc_feature (474)..(474): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
  modified_base (596)..(596): a, c, t, g, unknown or other
  misc_feature (596)..(596): n is a, c, g, or t
tcagctcgcgtgtccacgaccggtgctcgatttagagctcacgtattggggtttggggggaggaactgctcagttaggacccagacggaaccatggaagccccagcgcagcttctcttcctcctgctactctggctcccagagatcattggagaagtggtgatgacacagtctccggtcacctgtcttgtttttccgnggggagacgacgccctaccctctccgtggtcgccgaccagtcaggacgtacggttacggacgtaacttaggccgtaggtactcaggacaaggacggcctcgggcctaggccctaccgaactcctccgtacttatttccgttcggacccttaccgttaaacgcgggactagggtcgaaccttccgacgcgtacgtcacggcgngtaggtcggtcgtacggtacttcgtacnctcacgacatacgaactacgcanatcacgtacgtnttgcttaattntctcgtgactntgtanagactagcgtactcgtacgttcgggacgtacggtacgacgggtacaccgtaacaaccggtacgtggtactcgccgtacacgttctcgtgttcgtactctccgtccncgtgtaccg

SEQ ID NO: 5299 - DNA, 807 bp, Homo sapiens
  misc_feature: GYAE6OF01CO8ZO.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagcccaccctctcctgtgcggccagtcagagcgttaggacgaacttgcctggtatcagcaggacggcctggcctaggctcccagactcctcattcgtttcggccgtaccttttaaacgcgggtaccctaggtacggaacttcccgagtacccgtaggttccgacggtcggaccgtagggttcggggttcgtcgggggtacctttcggttactaccgtcctaccgaacctactacgtaaaacttacccgtaggacctaaacgttaccgttacggaacccgttacgttttcggtaaccgtttacggtttttaactttaccgttcgggttctaaacgggttcctaacgtttcgtaacgggtaaacggtaccgttacgggtttacccggttaaccgttaaacgggttttccggggaacccggggttaacgggggtaacccgtaaacgggggttaccgggtaaacccgttaaccggtaaaaacccgggtaaccggtttacggggttacggtacccggtacggtacccgtaacccgttaccgttacccggttcggtttacccttccgttaaacccgttcccttaccccccggtacgttaacggttcccg

SEQ ID NO: 5300 - DNA, 693 bp, Homo sapiens
  misc_feature: GYAE6OF01B5D1B.8.28.C06.1.454.CMB.1.raw
  modified_base (197)..(197): a, c, t, g, unknown or other
  misc_feature (197)..(197): n is a, c, g, or t
  modified_base (314)..(314): a, c, t, g, unknown or other
  misc_feature (314)..(314): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagtccaccctctcctggtcgccggccagtcgagagtcgttacggactaacgttacgccgtaggtactcagcgaggacggccgtggccacggcctcccgagtacctcctntacttcgtttcggccgttacttaacgacggtccaggtcgaacctcccgagccgtacggtcgacggcggcgtagggttggtcgtagggtactttcgttccacttctaccacctagtacaactaccgtgactaactcgtacggtacgttactttcgaacgtttacgttttacttaccgttgtacgtacgtcgtacgtactaggaacgtcgttcgggtacctttacggtacggttcgggaccgggtaacgggtaaccgtaaggggtaccgtaccgtaaacgaaacggttacgtcggtaacggtccgtacgacccgacgttacgttcgttccggtttaccttaccgtaccctttccccgttccccgaacttccgtaaacccgg

SEQ ID NO: 5301 - DNA, 778 bp, Homo sapiens
  misc_feature: GYAE6OF01C0G69.8.28.C06.1.454.CMB.1.raw
  modified_base (198)..(198): a, c, t, g, unknown or other
  misc_feature (198)..(198): n is a, c, g, or t
  modified_base (270)..(270): a, c, t, g, unknown or other
  misc_feature (270)..(270): n is a, c, g, or t
  modified_base (510)..(510): a, c, t, g, unknown or other
  misc_feature (510)..(510): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttcttgtttttccgnggggagagacgcccaccctctcctgtcggccggccagtcaagagacggttaggacgtaacttagctaggtancgagcaaggacggcctcggccaacggcctacccgaagtaccctcctactacgtttccgtttacggaccgtacccgttttaaaccggacgggacccgtaaggggttacgggaaccttaccccgaacggcccgtaacgggttaccgaacgggcggtaccgtaggggttcggggtaccgttacggggttacctttcggttaccaccgttcctacgaaccctaatacctaaaactttaacccgngtaactaacttcgtacggtaaccgttactttacgtactttaacggttttactttacgtgtactagtaccgtagtacgtaggaagtacgtcggttaccgttcgtacgggtttaccggacggggtaacgggtaccggtaacgggttaccgtacccgtaaacgtaaaccgtaacggttcgggtacggccgttacgaccctaccttcgttacccgtttacgttccgtttaaccctacgttttacccccgtacccgtccgttaagttacccgg

SEQ ID NO: 5302 - DNA, 793 bp, Homo sapiens
  misc_feature: GYAE6OF01AX040.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagacgccaccctctcctgtgcggcagtcagagcgttaggacgacttagcctgtatcagcagaggcctggccaggcctcccgagacctccctctacgttccttttcgggccgtaccgttttaaaccgacggggtcccaagggttaccgggaaacttcccccgaaggtccccgtaaagggtttccgaacggtcccgggacgtacgggttcgggggttacccgttcggggggtaacccttttccggtttacccgtaccgttacccgttacccaaaccccgtaaacttacctaaaaccgttaaaccccttcgtaacccgtaaacttccgtacggtaaccggttaccgtttttaggaccgtttaacggtttttaacttttccgttacggttcgttaacgtaccgtacgtttacggtacggtaaacggtaccggtttccgggttaccggtttaccgttaccggttttcggggaccggggtaacggggaaccggtaacgggtaccggacctaacgaaaccggtacgttggtacggtacgtacgcacccgtacttacgttccgttcttacctacttccgttccccgtactccgttaccg

SEQ ID NO: 5303 - DNA, 840 bp, Homo sapiens
  misc_feature: GYAE6OF01C0KW6.8.28.C06.1.454.CMB.1.raw
  modified_base (196)..(196): a, c, t, g, unknown or other
  misc_feature (196)..(196): n is a, c, g, or t
  modified_base (238)..(238): a, c, t, g, unknown or other
  misc_feature (238)..(238): n is a, c, g, or t
  modified_base (264)..(264): a, c, t, g, unknown or other
  misc_feature (264)..(264): n is a, c, g, or t
  modified_base (826)..(826): a, c, t, g, unknown or other
  misc_feature (826)..(826): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtcttgtttttccgnggggagagacgcccaccctctccgtgtgccggccagtcaggngcgttaggaccgtacttagctggtancgagcagacggccgtggccaggcctcccgagtacctcctactagttccgtttcggaccgtacccgttttaacggaccgggtacccgtacggttagggaacccttcccgaacggtacccgttaacgggttcccgagggaccgggtaccggtagggtttccggggttaccggttaggggggtttaacccttttccgggtttaaccgtaccttaccgttaccccgtaaccctaagtttaaacccaaacttaacccgtacgtaacgtaaacctttcccggtaacgtaacccggttttaacttttaccggtaaccgtttttaagtttttttaccgtttacgttcggtaacccgtacggtaccgtttaacggttacgttaacgggtaaccgtcccgtttaccggggttcccgtttaaccgttaccgggttttacccggggaccggggttacgggtaaacccgtaggggttacccggtaccgtaacgaaaaccggtcgttacgggtcacgtacggtccaaccgtcgttccgttacgtttcccgttacgtaccccgtttccgttaccccnccgtgtttacccgg

SEQ ID NO: 5304 - DNA, 612 bp, Homo sapiens
  misc_feature: GYAE6OF01AK1GK.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (353)..(353): a, c, t, g, unknown or other
  misc_feature (353)..(353): n is a, c, g, or t
  modified_base (397)..(397): a, c, t, g, unknown or other
  misc_feature (397)..(397): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagacgccaccctctcctgtcgcggccagtcagngcgttaggacaacttagcctggtatcagcagaggcctggccaggctcccagacctcctcattcgtttcggcgtcctttaacgaggtccagtcgaactcccgagcctaggttcaggcganaggtgggtctgggactttcgtcactctacactatacaactaacngactaagtctagacgtactttgacttaagttttacttcgtagtacgatcgtaacgtcgtaagaacggtcgtcgggtccgtttacgtaccggtttccgggacgggtacggtaaccgtagggtcgaaccctacgaaacggtacgtggtacgcgttcgaccaaccttcgtcgttacgttaccgtcttacgttaccccgttccctaccgttcgtacccg

SEQ ID NO: 5305 - DNA, 710 bp, Homo sapiens
  misc_feature: GYAE6OF01CAFOI.8.28.C06.1.454.CMB.1.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagacgccaccctctcctgtgcggccagtcagagcgttaggacgtaacttagcctggtatcagcagaggcctggccaggcctccagcctcctcattcgtttggacgtacctttaacgacgggccaggtggaactcccgacgccgtaggttcacggcggcgacggttggggtcgtaggggtacctttcgttacctacgtccttaccgacctacgttaactaaacttaaccctcggtacctaattccgtaggtaacccgtacgttttcggacttaagtttttactttacgtcgtactaacggctaacgttacctaggtaaacgtccgttacgggtcccgtttaccgtaacggtttccggggacggggtaaccggggaaccgtaacggggttaccggaacccttaacggaaacggtaaaccgtggtaacggtcgtaccggtaccaaccgtacgttcgttaccggtttacttaccgttacccgtttacccttacccccgacttaccgtacccgg

SEQ ID NO: 5306 - DNA, 679 bp, Homo sapiens
  misc_feature: GYAE6OF01DGT0B.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagagccaccctctcctgtcgccggccagtcagagcgttaaggactaaacttagcctaggtactcgaagcaaggaggccgtggccaggcctcccgaagcctcctcgattcgtttggccgtaccgtttaacgacgggaccaggtcggaaactcccgaagcccgtaggtccaggcggacagggttgggtcgtagggtcgttcgtcactcacacctatacaaactaactgacaatcgtacgtaacgttcttagtcttagtttaattctgtcagtctagtctaggaagtaccgtacggtccgttactacggttacgggacgggtaacgggacgtaaacggggttacgaacccgttaaccggaaaaccgtaaacggttgggtaacgggtcccgtaacggaaccctaacccggttaaacttccccgttagtttaccgttacccttaaacgtttcccgttaccccccggtaccttgttaacccgg

SEQ ID NO: 5307 - DNA, 582 bp, Homo sapiens
  misc_feature: GYAE6OF01C4I0O.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacaggccagtggaatcccagccaggtcagcgcagtggtctgggacttcgtcactctcaccatcaataacctgcaatctgacgtactttgctagtttattctgtcagtcagtctagaagactgggccgtttcacgtttcgggacgggtacgggacctaagggtcggacctacgaaaaccggtaactcggtacggtcttacggcctaacccgtaacttccgttacggttcctttacccgtaactttccccgtttacccccggtcccttacgttacccg

SEQ ID NO: 5308 - DNA, 877 bp, Homo sapiens
  misc_feature: GYAE6OF01B4JAQ.8.28.C06.1.454.CMB.1.raw
tcagctcgcgtgtccacgaccggtgctcgatttagagctcacgtattggggtttggggggaggaactgctcagttaggacccagacggaaccatggaagccccagcgcagcttctcttcctcctgctactctggctcccagtttcagataccaccggagagtattgtgttgacacaatctcacgccacctgtcttcgtctccgaaggggaaacgcgcccaccctctccgtgcgacgggccagtacaagaagttggtcgcgtcctacgtactccgttacggtaccaaacgacgaaacctcggaccgaaggccctcccgacggaccccctcacttactagtcgggtcacgacctaccgaaaccggacggggtaccctaacgtcggacctaccgtccccgaacggtaccccgtacgggttacaacgggttcgggtccggtaaaggggttcggggggttaagtagggggtaaacccctaagggtaccctttaacccggttaccttacccgttaccgaaacccgttaaactaccgtaaaccgttaaccttcggaacctaaatccgtacgtaaccgttaacgttttccgggattttacggtttttaacttccggttagttacctacggttaaccgtacgttacgttaacggtaacggtcccggtttaccgggtacccggtttccgtttaccgggtttacccgggggacggggttaacgggtaacccgtaacgggggttacccggaaaccccgttaaacggtaaaacccggttagggttacccgggttaggacccggttaccgtaaacccggtacccttaaacccggttcgttttacccgtacccgtttttaaccggtccccgtttaccccggttaccccccgg

SEQ ID NO: 5309 - DNA, 637 bp, Homo sapiens
  misc_feature: GYAE6OF01CMZ6Z.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgtttttccgnggggagagacgccaccctctcctgtgccggccagtcagagcgttaggacaacttagcctggtatcagcagaggctggccaggctccagactcctctactcgtttggctacctttaacgacgggccaaggtcggaactccccgaagcccgtaaggttcgacggcggtacaggtgggtcgtggggtacttcggttcactcgtaccacatacaataacctgacaatcgtacgacgtactttgacttagtttaacttcgtgtctacggctacgtactagaaacgtacgttcgggtacccgttacgtaaccggtttccgggacggggtaacgggtaaccgtaaacgggtaccggacccgtaaacgaaacgtaacgtgggtacggtcgtacgacaaccgtacttcgttacgtctttccgaactttcccgttccccgcttaatacccgg

SEQ ID NO: 5310 - DNA, 1045 bp, Homo sapiens
  misc_feature: GYAE6OF01D6C5U.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagacgccaccctctcctgtgccggccagtcagagcgttaggacgtaacttagcctggtatcagcaggacggcctggccaggcctcccgagacctcctcattcgtttcgggccgttaccgtttaacgacggggtccctaggtacgggaaacttccccgaacggcccgtaaggggtttccgaacgggccgggacgtaacgggttcgggggttccgtttacggggggtaccttttccgggtttaccaaccgtttcccgttacccgtaaacccctaatttaacccgtaaaaacctttaaaccccgttacggaacccttaaaacgtttccggtttaaacgggtaacccggtttaaccgttttttacggtaacccgttttaaacgggtttttttaactttttccggtttaaccggtttaccgttaaacgggttaccgttaacgggttttacccgttaacgggtaaaaccggttacccggtttaccgggggtttacccccgggtttttacccgtttaaaccccggggttttttacccgggggggaacccgggggggttaaaccgggggggttaaaacccccgggttaaaacgggggggtttaacccgggggttaaaccccccgtttaaaacccggggtaaaaaaaaccccggggttaaaaccccgggttttcgggggtttaaaccggggttacccccggtttaaaccggggtaaccccccgttaaaaccccggtttacccggttttaccccgggttttaccgggttttaacccccgttttacccgtttaaccccgttttaccccccggttttaccccccgggtacccccgttaaacgttttaacccccgggg

SEQ ID NO: 5311 - DNA, 684 bp, Homo sapiens
  misc_feature: GYAE6OF01E4YL4.8.28.C06.1.454.CMB.1.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagngcgttaggacgaacttagcctggtatcagcagaggcctggccaggcctcccagacctcctcacttcgtttggcctaccttttaaacgagggcctaaggtggaaacttccccgaagccgtaaggttcaggccggctaggtggggtctggggtacctttcgttcacttcctaccgaacccattaccaaacttaaccctgacctaaactcctacggtaaccgtacttttcggacgttaacgtttttactttccgttgtccagtcctaagttccgtaggaaacggtaccgttcgggtacccgttttccgtaaccggttttccggggaccggggtaacgggtaaacccgtaacggggttacgggaaccctaaccgaaaacggtacgttcggcggtacgtcgaccgacctacttccgttcgttaccttcctacttccccgtttccccgcgtcttaccg

SEQ ID NO: 5312 - DNA, 711 bp, Homo sapiens
  misc_feature: GYAE6OF01DNPA7.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (332)..(332): a, c, t, g, unknown or other
  misc_feature (332)..(332): n is a, c, g, or t
  modified_base (466)..(466): a, c, t, g, unknown or other
  misc_feature (466)..(466): n is a, c, g, or t
tcagctcgcgtgtccacgaccggtgctcgatttagagctcacgtattgggtttgggggagggaactgctcagttaggacccagacggaaccatggaagcccagcgcagcttctcttcctcctgctactctggcctccagagatcagttggagaagtggtgatcgacacagtctccggtcacctgtcttgttttccgngggganagacgccgacctctcctgtcgcggcagtcagngngttaggactattagctgtancgancgagnggccnggccgacggcctaccgacgtacctcctacgtagttcgtttcggaccgttaccgttaaacgnggcctaaggttcgaaacgttccccaaggccgttaacgggttcgaacggtgaccggtaagggttcgggtcgtaggggtttacctttcgtaccgtaaccgttctacctaacctaacgtaactaaaccgtaacctanaacctactacgtacggtacgttacgtttagtactttaagttttacttcgtagtacgtagtacgtagtacgtacgtaacgtcgtaccgtaccgttacgtaccgggttcgggaacggtaacgggtaaccggtaaggtaccgaaccgtaacgtaaacggtacgtcggtacggtccgtacgtaccgtaacgttcgttccgttacgtttacccgttactaccgtttcccgtaccgtaccgttcggtaccg

SEQ ID NO: 5313 - DNA, 814 bp, Homo sapiens
  misc_feature: GYAE6OF01BT42R.8.28.C06.1.454.CMB.1.raw
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcaccctgtcttgtttttccgnggggagagacgccacctctcctgtgcggccagtcaggacgtcggttaggacgtaacttagccgtggtacncgagcaggacggcctggccacggtcctacccgagtaccttcctcagtttccgtttgggccttaccgtttaacgcgggtacctaggtcggaaacctccccgaaggtcccgtagggttaccagggccggtacgtagggttcggggttcgtacgggggtaccctttcggttaccgtaccttccgtacccaacctaagttaccaaaacgttaccctgaacctaattccgtacgtaaccgttacgttttacgtactttaaggttttactttcgtacgttccgaacgttaccgtacgtttacgtaacggtaacgttacccggtaccgggtttcccgtttaccggttaacccggggttttaccggggaacccgggggttaaacggggtaacccgttaaggggtacccggtaacccgttaaccggaaaaccggttacggttcgggtacccgggtacgttaccggaccctaaccgttacggtttcccgtttaccggtttacccgtttccgtaacccgttttaccccggttaccccgtaccgttccgttaacccggg

SEQ ID NO: 5314 - DNA, 894 bp, Homo sapiens
  misc_feature: GYAE6OF01A797R.8.28.C06.1.454.CMB.1.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (883)..(883): a, c, t, g, unknown or other
  misc_feature (883)..(883): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtcctccggtcaccctgtcttggtttttccgngggganagacgcccaccctctcctgtcgccggcagtcaggacgtcggttaaggaccgtaattcgccgttaggtaactcgagcgaacggtacgggcccttcgggacccgacgggtccctccccgaaaggtacccttcccctacgttacgtttccggttttcggaccccggtttaccctttaaaccggaccgggggtccctaagggtacggaaaccttcccccgtaaagggccccgttaggggtttcccaaggggtcccgggtaccgaacggggtttcgggggtaccgttagggggtaacccgttttccggttaccaaccgtttccctacccggtaaaccttaccgtaaacctaaacgtttaaaacccgttacggactaaacgttccggttaacggtaacccggttacgttttacgacccgtttaaagttttttcgttaccgtcggtaccgtaacgtccgttagttaccgtaaggtaaccgttaccggttacgggttacccttacggtaccggtttccgggggaaccggaacggggttaacccgtaaggggttacccggtaaaccctaacccgggttaaaacggtacggttaccgggttacggtacccggttacggacccgtaaacggttctttacccggtcgtttaccttcccggtttaccttaaccccgtcccggtttaaaccngggttaacccg

SEQ ID NO: 5315 - DNA, 617 bp, Homo sapiens
  misc_feature: GYAE6OF01EPQ43.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (316)..(316): a, c, t, g, unknown or other
  misc_feature (316)..(316): n is a, c, g, or t
  modified_base (350)..(350): a, c, t, g, unknown or other
  misc_feature (350)..(350): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtctgtttttccngggganagagccaccctctcctgtgcggccagtcagagcgttaaggacgaacttagcctggtatcagcaggaggcctggccaggcctcccagacctcctcatctttggccgtcctttaacgngggccagtggaactcccagccaggttcaggcggnaggtgggtctgggtacttcgttcactctcaccatcaataacctgacaatctagacgtactttcgacttagttttactttctgttcagtcagttcgtaggaacgtacgttcgggtcccgtttcgtaccggtttccgggacgggtaacgggtaaccgaacgggttcggaaccctaacgaaaaccgtaacgttcggtcggtaccgtacgaccgaccgtacttcgttagttaccctttcgtaacctttcccttccccggtctacgttaccg

SEQ ID NO: 5316 - DNA, 900 bp, Homo sapiens
  misc_feature: GYAE6OF01AVHT6.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgtctgtttttccgngggganagacgcccaccctctcctgtgcggccagtcagagcgttaaggacaacttagcctaggtatcgagcgaggacggccgtggccgacggcctacccgacgaccttcctactacgttccgttttcgggacccgttacccgttttaaacgacgggggtacctaagggttacggaaaccttccccgaaggtccccgtaagggtttaccgacgggtacccggtccggtaagggtttcgggggttacgttacgggggttaacccttttcccgggtttaacctacccgtttccctaccctaaaccctaaagtttaaccccgtaaaaactttaaaccccggttacggtaacccttaaaccgtttccggttaacgggtaaaccccgtttaacgttttacggttacccgttttaaacgggtttttttaaccttttaccgtttacggttacccgtaacggtaccgttaacggtttcgtaaacgggtaacgttaccggttccgggtttacccggttttaccgttaaccgggttttccgggggaaccgggggttaaaccgggtaaccgggtaaacggggtttaccggtaacccgtaaccggtaaaaccgtacgggttacgggtccggtacgtccggacttaaccgtacgttaccgtttcgtttaccttaccggttacctttacccccttacccggaccttacggttacccgg

SEQ ID NO: 5317 - DNA, 801 bp, Homo sapiens
  misc_feature: GYAE6OF01AFOGS.8.28.C06.1.454.CMB.1.raw
  modified_base (204)..(204): a, c, t, g, unknown or other
  misc_feature (204)..(204): n is a, c, g, or t
  modified_base (748)..(748): a, c, t, g, unknown or other
  misc_feature (748)..(748): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctccagagatcattggagaaggtggtgatgacacagtcctccggtcacccttgttctttcgtttttccggnggggagacgacgtcccacccttcttccgttggtcggccggaccgtagtccgaaggtacggtacggttaacgggaaccgttaacgttcgccgttaggtactcgacgcgaaggacggtccgtcgggaccacgggtcctacccgagtacctcctacgttacgttccggtttcggtacccgttacccgtttaacggaacggggtccctaagggttaccggaacctcccggaacggtccggttaacgggttacgacgggaccggtcgttacgggttcggggttaccggttagggttacctttaccgttccaaccttcccgacctaaccgtacttacgtaaacctaccgtcgtaacgtaacgttacgtaccgtaacgttacttcggttaacttttacgtttactttacggtacttcgtacgttcgtaacgttacggtacggtaacgttacgttcccggttacgttaccggttaccgggttcgggacgggtaacggtaaccgttacggtacccgaccgtaaacgtaacgtcggtcggtacgacgtcgtacncgttacgttccgttacttccgttaaccttcccgttaccgcccgttgtctacgg

SEQ ID NO: 5318 - DNA, 581 bp, Homo sapiens
  misc_feature: GYAE6OF01A79VA.8.28.C06.1.454.CMB.1.raw
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (321)..(321): a, c, t, g, unknown or other
  misc_feature (321)..(321): n is a, c, g, or t
  modified_base (332)..(332): a, c, t, g, unknown or other
  misc_feature (332)..(332): n is a, c, g, or t
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
  modified_base (548)..(548): a, c, t, g, unknown or other
  misc_feature (548)..(548): n is a, c, g, or t
  modified_base (560)..(560): a, c, t, g, unknown or other
  misc_feature (560)..(560): n is a, c, g, or t
  modified_base (571)..(571): a, c, t, g, unknown or other
  misc_feature (571)..(571): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagactcattggagaagtggtgatgacactagtctccggtcacctgttcttgtttttccgngggganagcgccacctctctgngccggcagtcagagtacggtagacgtaatgctggtancgagcagcgcaggcagcnccgnactcnattcttggcctacttaacgcggctaggacgtaacnccgagtaccgngttaccgagcggtagagtggtcgtagtctttcgacncgtactcaacntactaaanaccgtnactaactcgtacacgttacttagtactttagtttactttacgcgttaacgacgttaccgtaagtcgtaagaacgtacgtcggtacgttcgtacgttcggaggtaccgacgtaggcgactcgaaacgtagngtaggtccngtaccgaacttacgtntcgttacgttcncttacccgacnctcgtaaccg

SEQ ID NO: 5319 - DNA, 823 bp, Homo sapiens
  misc_feature: GYAE6OF01DLVO2.8.28.C06.1.454.CMB.1.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattgggtttgggggaggaactgctcagttaggacccagacggaaccatggaacgccccagcgcagcttctcttcctcctgctactctggcctcccagagatcagttgggaagaagtggtgatgacacacgtctccggtcacccgttgttcttggtttttccgngggganaggacgccctacccttctccgtgtgtcggcctagtcagtacggtcgttaaggacgtaacgttcgaccgttggtatcgaggacgaacggacggcctgggacctacgggtccctacccgacgtaccctccttacgttactttccggttttcggaccgttaacccgtttaacggacggggtccctaaggtacgggtaaccttccccggaacggtacccgtaggttccgaacgggccggtaccggtagggttcggggtcgttacgggggttacctttccggttaccaccgttaccgtacctaaccttactaaccgtaaaacttacccgtagtaaccaacgttccgtaaggttaccgtacgttttacgtacctttagttttaacttcgttacgtacgtacgtacgtaacgtgtaaccggtaagtaccggttccggtacccgtttcggttaaccggttccgggggaaccggtaacgggtaaccggtacggttaaccggtacctaaaaccgggtaaccttacggtacggtaccggttaccacggtacccctaacgttcgttacccgtctttaacccgtccgttaccgtttacccctaccccggtattacgtacccgg

SEQ ID NO: 5320 - DNA, 549 bp, Homo sapiens
  misc_feature: GYAE6OF01CEMSX.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgtttttccngggganagagccaccctctcctgtgcggccagtcagagcgttaggacaacttagcctggtatcagcagaggcctggccaggcctcccagactcctcatctttggcgtcctttaacagggccagtggaatcccagccaggtcagcgcaggtggtctgggacttcgtcactctcaccgatcaataacctgactaactctacgacgtacgtttgctaagtttactttctgtcagtctacgtctgaagtacgtcgtcgttcacgtttcggcggtacgggaccagggtacgacctacgaaacgtacgtgtggtacgtcgacaccgctcgtgtaccgttacacttcctcccgcctgtaccg

SEQ ID NO: 5321 - DNA, 634 bp, Homo sapiens
  misc_feature: GYAE6OF01CCOAT.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggaccagtcaggagcgttaaggacgaaacttgccttggtatcagcagaggcctggccaggctcccaagctcctcattctttcggctacctttaacgagggcctagtcggaactcccgaagccgtaggttcaggcggactaggtgggtctggggtacctttcgttcgactcctcaacctatacaaactaacctgacaatctgacgtatttgcttagtttacttgtagtcagtctagtctaggaacgtacgttcggtaccgtttaccgtaccggtttcgggaccggggtagggtaaaccctaagggtacggtaacctaccgtaaaaacggaccttgggtacgggaccttcggaccctaaccgtagttccgttcttacgtttcctaacttccccgtttacccgtcctacgttaccg

SEQ ID NO: 5322 - DNA, 765 bp, Homo sapiens
  misc_feature: GYAE6OF01B0IZ9.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgngggganagagcccaccctctcctgtgcggccagtcagagcgttaggacgaacttagcctggtatcagcaggacggcctggccacggcctacccgacgacctcctctattcgtttcggccgtacctttaacgccggggtacctaaggtacggaactcccccgagacccgtaggtttaccgaggccgggtctacgggttcgggttaccggtcggggttaaccctttcggttaccaccgttaccgtaccaacccgtattaccgtaaacttaacccgtgaacctaacgttcgtacggtaccgttacgtttacgtaccgtttaagttttactttcgtacgttactacggtacttaacgtcgtaacgggtaacgttaccggttacgggttccccgttttacgttacccgggttttacccggggacgggggtaaccgggtaacccggtaacgggttaccggggaaccctaacggaaaccggtacggttcggtaccgggtaccgtcgtacccgaaccgtcttcccgttacgttcccgttacctaccgtttaccccgtccccgtccttagttacccgg

SEQ ID NO: 5323 - DNA, 684 bp, Homo sapiens
  misc_feature: GYAE6OF01A4OXY.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (255)..(255): a, c, t, g, unknown or other
  misc_feature (255)..(255): n is a, c, g, or t
  modified_base (642)..(642): a, c, t, g, unknown or other
  misc_feature (642)..(642): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgttcttgtttttccgngggganagacgcccacctctcctgtgcgccagtcagagtcgtagactaactgctgtancagcaggacgctggccaggcctaccagacctcctactacttcgttcggcctaccgtttaacgcgggacctaggtacggaactcccgagcccgtaggtcaggccggcgtaggtgggtctacggggtactttcggtaccctacgttcctaccgtaaccctataacccgtaaaacttacccgtacgaacctaattcccggtagtaaccggtttaccgtttgtaacgtttacgtttttacctttacgtcggtactacggtaccgtagttacgtaagggaaacctcgggttacggttcccgtttacgtaccgtttacgggggacgtaacgggaccgttaggacggtacccaaggtaaaccgagttcggtacggtccgtacgaccctacggtnttctacgttaccttacaccgtttcccaccgtcttagtaccgg

SEQ ID NO: 5324 - DNA, 610 bp, Homo sapiens
  misc_feature: GYAE6OF01A5ENV.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (408)..(408): a, c, t, g, unknown or other
  misc_feature (408)..(408): n is a, c, g, or t
  modified_base (568)..(568): a, c, t, g, unknown or other
  misc_feature (568)..(568): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgtaacttagcctggtatcgagcagacggcctggccaggcctcccagacctcctctattcgtttggctacctttaacgacgggcctaggtacggaactcccgagcctaggttacaggcggcgaggtcgggtcgtgggtacttcgtacactctacactatacaactacngactaatctagacgtacgtttgacttagttttactctgtacagtcacgtactagaacgtcgtacggtcccgttacgtacggtttacgggacgggtaacgggtaccgtagggtaccgtaacctacgaaaccgtacgttcggacggtactcgactaaccgtntccgttacgttcttaccgacttccctacccgtctacgtaccg

SEQ ID NO: 5325 - DNA, 714 bp, Homo sapiens
  misc_feature: GYAE6OF01C36DR.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgtaacttagcctggtactcagcaaggacggcctggccaggcctcccagacctcctcattccgtttggaccgtcctttaacgcgggacccaggtcggaacctcccgaagtccgtaggttcacggcggactaggtcgggtcgtacggggtacctttccgttcgtaaccttctaccacctactaacctaaacgttaaccctgacctaacgttccgtaacggtaaccgttacgtttcgtaccttttaacgtttttacgttttccgtaggttaccaaggtccttaggttctaaggtaacgtacgttccgggttcccgttacgttaccgggtttaccggggacggggtaacggggtaaccggtaacgggtaccgggtaaccctacgtaaaacggtaacgtcggtacggccgtcgacccgtaacttacgttccgttacgttctttaccgtaccttcccgttacccgtcctcgttacccgg

SEQ ID NO: 5326 - DNA, 731 bp, Homo sapiens
  misc_feature: GYAE6OF01CA3MG.8.28.C06.1.454.CMB.1.raw
  modified_base (195)..(195): a, c, t, g, unknown or other
  misc_feature (195)..(195): n is a, c, g, or t
  modified_base (258)..(258): a, c, t, g, unknown or other
  misc_feature (258)..(258): n is a, c, g, or t
  modified_base (720)..(720): a, c, t, g, unknown or other
  misc_feature (720)..(720): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcacctgtcttgtttttccgnggggagagacgccacctctcctgtcgcggccagtcagagtcgtaggacgtaacttgctggtancgagcgagaggcctggccaggtcctacccgagtacctcctctacgttccgtttcggaccgtaccgtttaacgacgggtcctaaggtacggaaccttcccgacggtcccgtaacggttccgaacggtccggtacgtaagggtttcggggtccgttacgggggttaacctttccgggttacctacccgttacctaccgaaccctaattacccgtaaaacttaacccgtgtaacctaactccgttaacgtacgttaactttcgtactttaacgttttacttcgtacggttctaagtcgtacgtcgtacggtaacgttacgttcggttacccgtttcgtaccggtttccgggacgggtaacgggtaaccgtacgggttaacggaccctaaacggaaaccggtacgtcggtacggtcgtacgacctactcgtacgttccgttacttaccggtacttccccggtcccncgtcgtaccgg

SEQ ID NO: 5327 - DNA, 877 bp, Homo sapiens
  misc_feature: GYAE6OF01B4X2V.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccaccctctcctgtcggccggccagtcagagtcgttaggacgtaacttaggccgttggtactcgagtacgaggacggccgtcgggaccgacggtcctacccgagtaccttcctactaactttccgtttacgggacccgttaccgttttaaaccgaccggggtaccctaaggttacgggtaaaccttaccccggaacggtaccccgttaaggggtttaccccgaacgggtccgggtaccgtaacggggtttcgggggttaccgtttacgggggttaacccgttttacccgggtttacaacccccgtttaccgttaacccgtaaacccgtaacttaaaccctaaaaccgttaaacccgttacggaactaaacgttcccgttaacggtaaccgtttaaccgttttacggttacgtttaaacgtttttaacgttttcgttacgttacccgtagtaccgtaacgttcgtaagtaacggttaaccgttccgggtcccttttaccggtaccggttttaccgggaccggggtaacgggtaaccggtaacggggtaccggtaacccgtaaaccggaaaccgtaccggtgggtaccggtacgttccggaacctacgtaaccgttcgttaccgttacttacccgttaccttccccgttacccgtccgtaacttaccggg

SEQ ID NO: 5328 - DNA, 781 bp, Homo sapiens
  misc_feature: GYAE6OF01BZLIS.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
  modified_base (272)..(272): a, c, t, g, unknown or other
  misc_feature (272)..(272): n is a, c, g, or t
  modified_base (771)..(771): a, c, t, g, unknown or other
  misc_feature (771)..(771): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctcccggtcaccctgtcttgttttccgngggganagacgcccaccctctcccgtggtcgccggaccagtcaaggngcgttaaggacgtaacttagcctggtancgagcgagacggctggccaggccaccagaccttcctactattcgttcggacctaccgtttaaacggcgggtacctaagggtacggaaacccttccccgaaggtccccggtaacgggtttaccgaacgggtcccggtaacggtacgggttcggggttaccgttacgggggtaaccgttttccgtttacccgaaccgtttcccgtaccaaacccttaacgttaaacccaaaaccgtttaacctaggaacctttaacgtaccgttaaccggtaaccgttaccttttacgtacgttttaacgttttacctttacgttaccgttacgacgtacgtacgttaccgtaaggtaactacgggttaccgttcccggtttaattacccgggtttaccgggaccggggtaaaccggtaccgtaaagggtccggtaacctacggtaaaccgtacgtcgtacggcgtacgcctaacgtacgttccgtagttccttcaccgttcctaccccgntaccgttacg

SEQ ID NO: 5329 - DNA, 613 bp, Homo sapiens
  misc_feature: GYAE6OF01BSJHO.8.28.C06.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgttttccngggganagacgcccacctctcctggtgaccggccagtcagngtcgtaggacaacttgcctggtancagcagaggcctggccaggctccgagacctcctcattccgtttggcctacctttaacgacgggcctaggtcggaaactccccgaagcccgtaggttcaggcggtcgaggtcgggtctagggacttcgttcactcgtacacctatcaactaaccgtgactaatctgacgtactttgcttagtttacttcagtctaagctagtctagaagtacgtggtccgtttacgtaccgtttacggcgggtaaggacccgtaaggtccgacctacgaaacgtaacgtggttacggacgttcggaccaaccgtagttccctgttaccctttaccgacgttacccgttccccgtactacgttaccg

SEQ ID NO: 5330 - DNA, 639 bp, Homo sapiens
  misc_feature: GYAE6OF01CY6WC.8.28.C06.1.454.CMB.1.raw
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctgggggagagagccaccctctcctgtgcggcagtcagagcgttaggacgtaacttagccgtggtatcagcagaggctggccaggcctcccgagacctcctctacttcgtttcggccgtacctttaacgagggcccaggtcggaactccccaggccctaggttccaggcggacgaggtgggtctggggtacttcgtcacnctcaccatacaactaccngactaacttctagtacctacgtttcgactttagttttactttcgtgttacgaacgtcgtacgtctaggtaacgtacggttcggtccgtttccgtaacggtttccgggacgggacgggtaccgtaaacgggttcggtaccgtaacgaaacggtacgtacggtcgacgtcggacctacctattcccgttagtttcccttacgtacctttcccttcccgacgtactccgg

SEQ ID NO: 5331 - DNA, 856 bp, Homo sapiens
  misc_feature: GYAE6OF01EC6S6.8.28.C06.1.454.CMB.1.raw
  modified_base (205)..(205): a, c, t, g, unknown or other
  misc_feature (205)..(205): n is a, c, g, or t
  modified_base (840)..(840): a, c, t, g, unknown or other
  misc_feature (840)..(840): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctccagagatcattggagaagtggtgatgacacagtcctccggtcacccttgttcttgtttttccgaggganagacgcccacccttctccgtggtcgccggcagtcgaaggacgtacggttaacggaccgtaacgttcgccgttaggtactcgagcgacggacggtcccgtgggacccgacggtccctacccgacgtacctccctacgttacgtttcgtttcgggtacccttaaccgtttaaacggaccggggtacctaagggttaccggaaaccttccccggaagtacccgtagggttaccgacgggtccgggtcgtagggttccgggtacgttcggggttacctttccggtcctaaccgttcccgtaccgtaaaccctaagttacctaaaccgttacccgtgtaacccttaagtccgtaacgttaacctttacgtttacgtagtttagtttttacgtttcgaggttactacgttacgtaagttaccggtaacgtaacggttaccgttccggttacccgtttcggtttaaccggggacccggggtcgggtaaaccgggtaaccggttaacggggtaacccgttaaaccctaacgggtaaaaccggtccggttacggggtaccgtaaccgtttcccgtaaccccgtaaacggttcgtttacccgttaccgttttcccttaacccggttcccttcccccgtttaaccncggtttcgtacccggg

SEQ ID NO: 5332 - DNA, 673 bp, Homo sapiens
  misc_feature: GYAE6OF01CVTAI.8.28.C06.1.454.CMB.1.raw
  modified_base (159)..(159): a, c, t, g, unknown or other
  misc_feature (159)..(159): n is a, c, g, or t
  modified_base (202)..(202): a, c, t, g, unknown or other
  misc_feature (202)..(202): n is a, c, g, or t
  modified_base (471)..(471): a, c, t, g, unknown or other
  misc_feature (471)..(471): n is a, c, g, or t
  modified_base (522)..(522): a, c, t, g, unknown or other
  misc_feature (522)..(522): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctccagagatcattggagaagtggtnatgacacagtcgtccggtcacccgttgttctttgtttttccgnggggagagacgcctaccctctcgtgtcgccgaccaggtcaagagtcggttaaggacgtaacttcgacgtaggtactcgagtcgaacggtcggccgtcggccacggtcctaccgaatcctcctatacgttttcgttacgtaccttaccgttaaacggcggactaggtacgaacctacccgagtaccgtaggtcgacgtcggacgtaggttcggtccgttagggtcctttcgacttaccgtactactaacctataaaccgtaattacccgnactaacgtctagtacttacgttcgtatttagtttcttcgtatagactgtancgtagtacgtcgtcgtccgttacgtcggtacggaaggtacgacgtacggtctaccgtaacgtaaacggtcgtacgtccggtacgtacgaacccttcgtacttccgttaaccgttctttaaccctcttaccccgttacaccgttacgtaccg

SEQ ID NO: 5333 - DNA, 740 bp, Homo sapiens
  misc_feature: GYAE6OF01BD48W.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgtttttccgnggggagagacgcctaccctctcctggtcgcggccagtcagagtcgttaggacgtaacttagcctaggatcagcagacgggctggccacggctcccagacctcctcacttcgtttcggccgtacctttaaacgcggcctaaggtcggaaactcccgaagtccgtaggttcaggtcggcgtaaggtccggggttacgtagggggtacctttcggttactaccgttccgtacaaccctatactaaacttaaccctgtaaccaacgttactacgtaccgtacgtttacgtacgttagttttaacgttcttggttactacggtctacgttacgtacggtaacggtacgttcgggtccgtttaccggtaccggttttaccgggacggggtaacgggaacccggtaacggggttaaccgggtaacccgtaacggtaaaaccggtaaacggtcggttaccgggaccgttacggtaaccctaccggttaacttccgttacggtttacccttacgtactttaccccgttaccccggtccgttaacgttaccggg

SEQ ID NO: 5334 - DNA, 716 bp, Homo sapiens
  misc_feature: GYAE6OF01AW9TG.8.28.C06.1.454.CMB.1.raw
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtccaccctgtcttgtttttccngggggagagagccaccctctcctggtgcggccagtcagagcgttaggacgaacttagcctggtatnagcaggacggcctggccacggcctcccgagacctcctctacttcgtttcggccgtcctttaacgcgggccagtggaacctcccgagcccgtacggttacgacggccggcgtaggtcgggtcgtcgggtacgttcgttcgactcctaccgacctactacctaactaaccgtcgactaacgttctacggtaaccgttactttcggtactttaaggttttacttttcgttacgtacgtacgtacgtagtccgtagtaaacggtcgttaccgggtacccggtttaccgttacccgggtttccggggaccggggtaaccggggtaaccgtaacggggttaccggtaacccgttaaccgtaaaacggtaaccggttgggttaccggtcggtacgtacccaaccgttctccgttgttaccttaccgtaccgtttacccgttccccgtacgttaccgtaccg

SEQ ID NO: 5335 - DNA, 693 bp, Homo sapiens
  misc_feature: GYAE6OF01AB8X7.8.28.C06.1.454.CMB.1.raw
  modified_base (161)..(161): a, c, t, g, unknown or other
  misc_feature (161)..(161): n is a, c, g, or t
  modified_base (208)..(208): a, c, t, g, unknown or other
  misc_feature (208)..(208): n is a, c, g, or t
  modified_base (545)..(545): a, c, t, g, unknown or other
  misc_feature (545)..(545): n is a, c, g, or t
  modified_base (688)..(688): a, c, t, g, unknown or other
  misc_feature (688)..(688): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctacccagagatcattggagaaggtggtnatgacacagtcctccggtccacccttgttctttgttttccgaggganagcgcccaccttctccgtggtcgccggcctagtcacggtagtaccgttaaggaactaacgttggtccgtaggttactacgagtaccaggtaccggtccgtacgggaccgaccggttccctacccacggttacctcccgttataccgtttacgtttcggaccttacccgtttaacgagggacctaggtacgaacctccgacgtacctaggtccaggcgtgtaggtcggtcgttcgggtacttccggtctaccgtactaccgtaccaagtaacctaacttaaccgctaactacgttccgtaacgtaccttagttccgtaactttagttttactgttacncgtacgtacgtagtaacgtacggtaacgtaccgttcgtaccgttcgtacggttaccgggacgggtacggtaacgtacgtaccggactaacggaactcgtagacgcgtctacgatcgtcttctactctacccgtctcctacgtntaccg

SEQ ID NO: 5336 - DNA, 810 bp, Homo sapiens
  misc_feature: GYAE6OF01AXIAM.8.28.C06.1.454.CMB.1.raw
  modified_base (200)..(200): a, c, t, g, unknown or other
  misc_feature (200)..(200): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtcctccggtcaccctgtcttggtttttccgnggggagagacgcccaccctctcctggtcgacggccaggtcagacgtcgttaaggactaacttaggcctaggtatcgagacgaggacggtcctcgggccgacggtcctacccgagtaccctccgtctaattccgtttaggtcgggtacgacctaacctacccggaaacgggaccggggacccctaggtccgggacctaccgtaccccgacggtaccgtacgggtttacgaacggggttcgggaccgtaagggggttcggggtaaggtacgggggtaactaacggtttacccttaccgtaaccttacccgtacctaacccgtaactcctacgtaaccgtccggtaccggttacgggaccgtaccgtaggggtaacggtacggtttggttacggtacgttttaaggttttaaccttacggtacgtacctaaaccgttcgttaccgggttaaccggtcggggttacccgggtcccggggttacccggggtacccgttaccggttaccccggggtccggtaacgggtaaacccgtaagggtacggttaacgttaccgaaccgtaaacggtcgttcggacgttaccgcgaccgtaaccgtcgttaccgtcgtttcc

SEQ ID NO: 5337 - DNA, 541 bp, Homo sapiens
  misc_feature: GYAE6OF01AEZ16.8.28.C06.1.454.CMB.1.raw
  modified_base (307)..(307): a, c, t, g, unknown or other
  misc_feature (307)..(307): n is a, c, g, or t
  modified_base (503)..(503): a, c, t, g, unknown or other
  misc_feature (503)..(503): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagcccaccctctcctgtgcggccagtcagagcgttaggacgtaacttagcctggtatcagccaggaggcctggccaggcctcccagacctcctcatctttggcncctttaacgacggccagtcggaatcccagccaggttcagcggcagtgggtctgggacttcgtcactctcactatcaatacctgactaatctacgactactttgactagtttattctgtctagctagtctgaagcgtcggccttcacgtttcggacggtacggaccgtaaggtcgacctacgaaacgacgtgtcggntcgacacctntctntcttcatccctcccgtctacgtcg

SEQ ID NO: 5338 - DNA, 731 bp, Homo sapiens
  misc_feature: GYAE6OF01EXNTC.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattggggtttggggggaggaactgctcagttaggacccagacggaaccatggaagccccagcgcagcttctcttcctcctgctactctggctcccagagatcattggagaagtggtgatgacacagtctccggtcaccctgtcttgttttccgnggggagagcgccaccctctcctgtcgcggccagtcagagtcgttaggacgaacttagcctggtactcagcaggacggcctggccgaggcctacccgagtacctcctctacgttcgtttcgggccgtaccgtttaacgcgggaccctaggtacggaactccccgaggcccgtaggttccacgggcggcgtaggtcgggtaccgtggggtacctttcggtacaccttcctactaaccctataccaaactaacccgtgaacctaacgttccgtacgaccgttacgtttcgacgtttaggttttactttcgttcgtactacggtacgtacgtttacgaggtaacgttccgttacgggtcccgtttaccgttacccggtttaccggggaccggggttaaccgggtaaccggtaaagggtcccggtaaacccgtaacggtaaaccggtaacggttcgggtaccggtacgtcggtacaaccgtcgttaccgttcgttaccttaccgtaccttaccccgttccccggtactcggttaccgg

SEQ ID NO: 5339 - DNA, 1008 bp, Homo sapiens
  misc_feature: GYAE6OF01BW41H.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgttttccgngggganagacgccaccctctcctgtcgcggccagtcagacgtacgttaacggaacgtaacttagccgtaggtatcgacgacaaggacggccgtggacccgaggcctacccgaaggtaccctcctacgtaacgttcgtttacggaccgtaacctttaacggacgggtacccaaggttacggaaactccccgaaggtacccgtaacgggtttaccgagggtaccggtaccggtaagggtttcgggggttaacccgttacggggtaaccttttcccggtttaccgtaaccgtttacccgtaacctaaacccgttaaactaaccgtaaaaaccgtttaaaccgtcgttaaaccgtaacgtttacccgtttaaccggaaaccggtttaacctttttacgggaaacccgtttttaacggttttttaaacgttttacccgttacggtttaaccgttaaacgggtacccgtttaaacggtttacccgttaaacgggttaaaaccgggtaacccgtttcggggtttaacccccgttttaaccgggtttaacccggggttttacccgggggaaccgggggttaaaaccgggtaaacccgggtttaaaacggggttaccccggggaaaaccccgtttaaaccgggtaaaaaacccgggttaaccgtttaacggggtaccggggtttaacccgtaccggtaaacccccgttaaacccggttaacgtttaccccggtttaccgggttttaacccttttacccgttaaaaccccgtttccccccttttaacccccggggtaaccccttaaacggtttaacccccggg

SEQ ID NO: 5340 - DNA, 771 bp, Homo sapiens
  misc_feature: GYAE6OF01DSPS5.8.28.C06.1.454.CMB.1.raw
  modified_base (730)..(730): a, c, t, g, unknown or other
  misc_feature (730)..(730): n is a, c, g, or t
  modified_base (763)..(763): a, c, t, g, unknown or other
  misc_feature (763)..(763): n is a, c, g, or t
tcagctcgcgtgtccacgaccggtgctcgatttagagctcacgtattgggtttgggggaggaactgctcagttaggacccagacggaaccatggaagccccagcgcagcttctcttcctctgctactctggcctccagagatcagttggagaggtggtgagtgacacgagtccgtccggtacctacccgttgttcgtttcggtttttcccggagggggagacgaccggcccctaccccttcgttccgtggtcggccggtacctaggtacgagggacggttacggtttaaacgggaaccgttaacgttacggtaccggttaggggtactacgacggacgaacgggacggtccgtcggaccgaccggtcctacccgacgtacctcctactacgtttcgttcggtaccgttaccgttaacggccggtaccgtaaggtacggtaacctccgacggtaccgtaacggttcgacggtcggaggtacgggtcggtcgtacgggtacctttcgtacctacgttcctacgactacgtaactaactacgtacgactaacgtcgtacgtaccgttagtttacgtaacgtttacgtttacgttcgtcggtacgacgtacgtagtagtaacggtacgtcgtcggttaccgttacggttaccggtcgggacgggtaacggtaccgtaacgggtacccgtaacgtaacgaacggtacggtcggtacgtccgtactacgtacgttnttaccgttctccgttacgtacctaccgtacccngtgtaccg

SEQ ID NO: 5341 - DNA, 618 bp, Homo sapiens
  misc_feature: GYAE6OF01C4RTB.8.28.C06.1.454.CMB.1.raw
  modified_base (158)..(158): a, c, t, g, unknown or other
  misc_feature (158)..(158): n is a, c, g, or t
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (258)..(258): a, c, t, g, unknown or other
  misc_feature (258)..(258): n is a, c, g, or t
  modified_base (292)..(292): a, c, t, g, unknown or other
  misc_feature (292)..(292): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtnatgacacagtctccggtcaccctgtctgtttttccgngggganagacgccacctctcctgtcgcgccaggtcagagcgttaggactaacttagctggtancagcaggaggcctggccaggcctcccagactccnctatcgttcggcgttcctttaacgacgggcagtcggaactcccgagccgaggttcaggcgacgaggtgggtctagggtaccttgtcactctcactatacaatacctgactatctacgtacgtatttcggatttacgtttatttcgtcgtacgtacgtctaacggttctaacggtaacgtaccgttcgggtacccgttccgttaacggtttccgggacgggtaacggggtaaccgtaagggtaccgactaaccggaaacgtacgttcggtgacgtcacctactacgttcgtagttcctacgtactttccctccccgcttacgtaccg

SEQ ID NO: 5342 - DNA, 751 bp, Homo sapiens
  misc_feature: GYAE6OF01BUJ75.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattggggtttggggaggaactgctcagttaggacccagacggaaccatggaagccccagcgcagcttctcttcctcctgctactctggcctccagagatcattggagaagtggtgatgacacagtcctccggtcaccctgtcttgttttccgnggggagagacgcccaccctctccgtggtcggccggaccaggtcaggacgtacggttaggaccgtaaacgttacgccgttaggtactccgagcgaacggacgggtcccgtggacccgacggcctacccgagtacctccttactacgttcggttttcggaccgtttaccgtttaacggacgggtaccgtaggtacggaactccccgagtaccgtacggttacgacggcggtacgtagggttcgggtaccgtaggggtccctttcgtccaacttccgtaccacctactaactaaactacctagactaacgtcgtacgtacgttctttacgtacgtttagttttacttccgtagtacaggtctacgttacgtaggtaacgtacggttccggttcccgtttacgttacgggttaccgggacggggttaaccggggaaccgtaacggggtccgaacccggtaaccgtaaacggtacgtcgggtaccggacgttaccgaacctactacgttccgttacggtttcttaccctacgtttcccctcccggtaactcggttaccg

SEQ ID NO: 5343 - DNA, 723 bp, Homo sapiens
  misc_feature: GYAE6OF01BELXC.8.28.C06.1.454.CMB.1.raw
  modified_base (582)..(582): a, c, t, g, unknown or other
  misc_feature (582)..(582): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacactattctccggtcaccctgtcttgtttttccgtggggagagacgcccaccctctccgtggtcgccggccagtcagaggtcggttaaggacgtaacttacgccgtggtactcgaagccgaaggacggcctggcccaggcctacccgagtaccctcccgtactacgtttccgttttcggggaccgttacccgttttaaaccggacggggtccctaaagggtttaccgggaaaaccttcccccgaaggtaccccggtaagggtttaccgacggggcccgggtaccgtaggggttcggggttaccggttacgggggtaccttttcgtacccgaaccttcctaccgtaaccctagttaacctaaacgttaacctcgaactaacgttcgtacgtaacgttacgttttgactttagtttactttntcgtacagtctagtcgtagaacgtcgttcgtcgttacgtacgtttcgggacggtacgggtaccgtaaggtacgactacgaaacgtacgtgcgtacgtcgtacacgtctcgttctccgtactacgttccctcctcgtcgtcg

SEQ ID NO: 5344 - DNA, 601 bp, Homo sapiens
  misc_feature: GYAE6OF01EH4GS.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
  modified_base (380)..(380): a, c, t, g, unknown or other
  misc_feature (380)..(380): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagagcgttaggacgtaacttagcctggtatcagcagaggcctggccaggctcccagacctcctcattctttgggccgtcctttaacgnggggccaggtcggaactcccagccaggttcagcggcaggtggtcgtgggtacttcgtcactcncaccatacaaatacctgactaatctacgacgtacgtttcgacttagttttactttctgttcacgtctagttcgtagtaacgtacttgggtccttacgtaccgtttcggggacgggtaacgggtaccgtaacgggtcgaaccctacgaaaaccgtacgttggacggtacgtcgacctacctcgtccgttgtcctttacacttcccgttcccgccctattccg

SEQ ID NO: 5345 - DNA, 615 bp, Homo sapiens
  misc_feature: GYAE6OF01ETWKF.8.28.C06.1.454.CMB.1.raw
  modified_base (194)..(194): a, c, t, g, unknown or other
  misc_feature (194)..(194): n is a, c, g, or t
  modified_base (480)..(480): a, c, t, g, unknown or other
  misc_feature (480)..(480): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctcggtcaccctgtctgtttttccnggggagagagccaccctctcctgtcgcggccagtcagagtcgttaggacgaacttacgccgtggtactcgagcaggacggcctggaccgaggcctacccacgtacctcctactattcgtttcggccgtaccttttaaacggacggggtcctaggtacggaactccccgacggtccgtaggttccgaggtccggcgtaggtcgggtcgtggggtactttcgtctactcgtcactatacaatacctgacatctagacgtattgactagtttattcgtgtcagtctatnagatcgtcgtcgttcgtacgttcgggacggtaggaccgtaggtcgaccgtacgaaacgtacgtaggtcgtcgtacgacctaccgtcttaccgttcgttaccttacgtacctttacccgttccccgacgtctaccg

SEQ ID NO: 5346 - DNA, 672 bp, Homo sapiens
  misc_feature: GYAE6OF01E00V2.8.28.C06.1.454.CMB.1.raw
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (334)..(334): a, c, t, g, unknown or other
  misc_feature (334)..(334): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtcctccggtcaacccctgtcttgtttttccnggggganagagcccacccttctcctggtgccggccagtcagagcgttaggactaacttgccttggtatcagcagaggcctggcctaggcctacccagacctcctactacttcgtttgggcctaccgtttaaacgngggaccctaaggtcgggaaacctcccccgaagtcccgtaagggtttccgaaggtcccgggacgtagggtcggtccttaggggtacccttttcggtttaccaccgttcctcgaaccctagttacctaaaactaccgtgacctaaacgtcttacgacgtactttgactttaagtttacttacgtcgtctagtcctagttctagaacgtcgtcggtccgttcgtaaccggttcggaccgggtaagggaacccgtagggtacgtaaccgtacgaaacggtacgttggacgcgtcgacctacgtattccgtatccgttctacgtccctcccgtcctgttaccg

SEQ ID NO: 5347 - DNA, 596 bp, Homo sapiens
  misc_feature: GYAE6OF01DVRFL.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgcctgtttttccngggganagagccaccctctcctgtgcggccagtcagagcgttaggacgaacttagcctggtatcagcagaggcctgccaggctccagactcctcatctttggcgtcctttaacgngggccaggtggaactcccagccaggttcagcggcagtgggtctgggacttcgtcactctacacatcaataccgtgacaatctgacgtactttgactagtttaattctgtacagctagtctagtagacgtgtaccgtttactaccggtttcgggacgggtacgggtaaccgaagggtcggaaccctacgtaaaaccgtaacgttcggtaggtaccgtacggtaccaccggtacttaccgtacggtttaccttctaaccgttccctttaccccggcctacgttacccg

SEQ ID NO: 5348 - DNA, 617 bp, Homo sapiens
  misc_feature: GYAE6OF01BXWMR.8.28.C06.1.454.CMB.1.raw
  modified_base (209)..(209): a, c, t, g, unknown or other
  misc_feature (209)..(209): n is a, c, g, or t
  modified_base (326)..(326): a, c, t, g, unknown or other
  misc_feature (326)..(326): n is a, c, g, or t
  modified_base (412)..(412): a, c, t, g, unknown or other
  misc_feature (412)..(412): n is a, c, g, or t
  modified_base (608)..(608): a, c, t, g, unknown or other
  misc_feature (608)..(608): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcaccctgtcttgttttccgtgggaggggggganacgccacctctcctgtgcggccagtcagagcgttaggacgtaacttagcctggtatcagcagaggcctggccaggcctcccgaagcctcctctattcgtttggccgtaccttaacgngggccaaggtgaacctcccagccgtaggtcacggcgcgtagtggggtctagggactttcgtacacttctacactagtacaactacngactaatctacgacgttacttgtacttaagtttcgttctagtccgagtactacgttcgtagaaacgtcgttcggtacttcgtaaccggttcgggacggtaacggacgtacggtacgtacaaccgtaaacggacgtaggtcggtacgtcgaaccgtaccttcgtacttagttcccttacgtaccttcccgttacccncgtcgtacg

SEQ ID NO: 5349 - DNA, 823 bp, Homo sapiens
  misc_feature: GYAE6OF01D0WRR.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (258)..(258): a, c, t, g, unknown or other
  misc_feature (258)..(258): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccgtcaccctgtctgttttcgngggagngacgccacctctcctgtgcggcagtcagagtcgtaggacgaacttagccgtaggtacncagcagacggcctggccaggcctcccgaacgtacctcccttacgtattccgttttacgggcccgttaacccgtttaaacggacggggtacctaaggtacgggtaaacctccccgaaggtacccggttacgggttaccgacgggaccgggtaccgtaaggggttcggggttaccgttcggggtacccttttacggtacccttaaccttccgtacccgtaaaccctacgtaacctaaacgttaacccgtagtaacctaacgttcgtaaccggttaaccggtttaaccgttttacggtaacccgttttaagtttttaacttttcggttacgttacgtaacgtaccgttaaggtttacgtaaggtaacgttaccggttcgggtaccccggttttacgttaaccggtttccgggggaaccgggtaacgggtaaccggtaaacgggttaccggaaccctaaacggtaaaacggtacgttgggtacgaccggtcgtaacccgtaacgttcgttaccgtttcggttacccttaccttaccgtttccccgtacccggtaccgttacgtaccggg

SEQ ID NO: 5350 - DNA, 890 bp, Homo sapiens
  misc_feature: GYAE6OF01A6I8N.8.28.C06.1.454.CMB.1.raw
  modified_base (146)..(146): a, c, t, g, unknown or other
  misc_feature (146)..(146): n is a, c, g, or t
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (270)..(270): a, c, t, g, unknown or other
  misc_feature (270)..(270): n is a, c, g, or t
tcagctcgcgtgtccacgaccggtgctcgatttagagctcacgtattgggtttggggggaggaactgctcagttaggacccagacggaaccatggaagccccagcgcagcttctcttcctcctgctactctggcctcccagagatnattggagaagtggtgatgacacagtctccggtcaccctgtcttcgttttcgnggggangacgccacctctcctggtgccggccagtcaggagtacggttaaggacgtaacttagcctaggtacncgagacaggacggccgtggacccacggcctacccgaagtacctccttacgaacgtttccggtttacggacccgttaacccgttttaaacggacgggggtacctaaggtacggtaaaccttccccgaaggtaccgtacggttacgaggaccggtacggtaacgggttggggtacccgtaaggggttacctttaccggttaaccaaccgtttcctacccgaaaccgtaacttaacccgtaaaaactttaaaccgtagtaaaccctaagtttaccggtaaccgggttaacctttaacggttttacgggttaaaccttttaacggttttttaacgttttaccgttacggttaaccgtacgttaaacccggttagttaaccggtaagttaaacgggtccgtttaccggggttaccgtttaaccgttaaccggggtttacggggaaccggggttaaaccgggggaaccgttaaacgggggtttaacccggaacccgttaaaaccggtaaaaccggtacgtttacgggaccggttaaccggtacgtaacccgtaacttaaggttacccgttacggttacccttaacgttccctttaaccccggttaccccgaacttagggttaaccc

SEQ ID NO: 5351 - DNA, 672 bp, Homo sapiens
  misc_feature: GYAE6OF01DS61Q.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
  modified_base (626)..(626): a, c, t, g, unknown or other
  misc_feature (626)..(626): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccaccctctcctgtcgacggccagtcagagtcgttaggacgtaacttagcctggtanacagcgagacggcctggccgacggcctcccagacctcctctagttccgtttcggcttacccgtttaacgacgggacctaggtcggaacctcccgacgccgtagtcgacggcggacgtagggtcggttcggtaggtacctttcggtactcctacgtaccacctaatacctaaactactacgactaatcctacgtaaccgttacgttacgttaccgtttagttttacttcgtcgtactacgtcgtagtcgtagtaacgtcgtcggtccttaccgtacggttaccgggacgggtacggtaccggtaacggtaccggaaccgtaacggaaccgtacgtaggtccgtcggtcctaccgtaccgtnttaccgttcgttacttccgaccgtttccctcccggcttacggtccg

SEQ ID NO: 5352 - DNA, 702 bp, Homo sapiens
  misc_feature: GYAE6OF01EAKGZ.8.28.C06.1.454.CMB.1.raw
  modified_base (199)..(199): a, c, t, g, unknown or other
  misc_feature (199)..(199): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcacccgtgtcttgtttttccgnggggagagacgccaccctctcctgtcgcggccagtcagagtcggttaggacgtaacttagcctggtatcagcgaggacggcctggccaggcctcccgagacctcctcattcgtttcgggccgttaccgtttaacgcggggcctaaggttcggaaccttccccgaaggtcccgtagggttccgacggtccgggactacgggttcgggttcgtcggggtacctttccgttccaaccgttcctacgtaccctaattaccgaaacttaaacccgtggtaacctaacgtccgttacggtaaccgttaccgttttagtaccgtttaagttttaactttcgttacgtacgtacgtactacgtcgtaagaacggttcgtcggtccgtttcgtaccggtttcgggacggggtaacggacgtaacgggtacggaccgtaacgaaacgtacgtcggtacgtacgtcgaccacgtacttccgtacgttcttcgtacttccctcccgtctacgtcg

SEQ ID NO: 5353 - DNA, 955 bp, Homo sapiens
  misc_feature: GYAE6OF01CHZQA.8.28.C06.1.454.CMB.1.raw
  modified_base (233)..(233): a, c, t, g, unknown or other
  misc_feature (233)..(233): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtctgtttttccgtgggagagacgccaccctctcctgtcgcggccagtcagngcgttaggactactagcctaggtatcgagcagacggcctggccagacctcccaacggtaccttccctactatttccgtttcggacccgttacccgttttaacggacggggtccctaagggttacgggaaccttccccgtacgggtacccgtacgggttaccgaacgggtccgggtaccggtaggggttccggggttccgggtttaggggggtaacccctttttccgggtttaccctaacccgttccgttaaccctaaccccgtaaagtttaacccgtaaaacccgtttaaaccccgtagggttaacccgttaaactttcccggttaaccggttaaccggttaaccgtttttaccggttaacccgtttaaggttttttttaaccttttccgtttaccggtttaccgaaacggttcccggttaaaccggtttccgttaaggggtaaacggtaccggggttttaccggggttaccccggtttttaaccggtttaccgggttttaacccggggggtaacccggggggttaaaccggggggtaaaccccgggttaaacgggggttaccgggtaacccccggttaaaccgttaaaaacccgggtaaccgtttcggggtaaccgggtaccggttaccggtaacccgtaacccctacggtttcccgttacgggtttacctttacccgtaacccgtttcccccgttaccccgtcccgttacgttacccggg

SEQ ID NO: 5354 - DNA, 678 bp, Homo sapiens
  misc_feature: GYAE6OF01D67V8.8.28.C06.1.454.CMB.1.raw
  modified_base (496)..(496): a, c, t, g, unknown or other
  misc_feature (496)..(496): n is a, c, g, or t
  modified_base (622)..(622): a, c, t, g, unknown or other
  misc_feature (622)..(622): n is a, c, g, or t
  modified_base (637)..(637): a, c, t, g, unknown or other
  misc_feature (637)..(637): n is a, c, g, or t
  modified_base (641)..(641): a, c, t, g, unknown or other
  misc_feature (641)..(641): n is a, c, g, or t
  modified_base (671)..(671): a, c, t, g, unknown or other
  misc_feature (671)..(671): n is a, c, g, or t
  modified_base (675)..(675): a, c, t, g, unknown or other
  misc_feature (675)..(675): n is a, c, g, or t
tcagctcgcgtgtccacgaccggtgctcgatttagagctcacgtattggggtttgggggaggaactgctcagttaggaccagacggaaccatggaacgccccagcgcagcttctcttcctcctgctactctggcctccagagatcagttggaggaagtggtagatgacacagtccgtccggtctaccttggttcttacggtttttccggaggggacgacgcgacctcctctcgtgtacgccgacgtagtcgagtacggtacggtaacgactaacttcgtcgtaggtatcgagcgtaacggcggtaccggtcggaccgacgggtaccctaccgtacgtaacccttccctagttaccgttccggttccggtacttaacccgttaaacgggcggttaccgaggtcggaacctccgaacgtccggtaagtccgcgggacgtcggtagggtcggttacggtggtacctttcgctaactcgtacaacgcttataaccgtacngtacacgtgtcgtacttacgtgttactttacggttattcgagtacgtactcgttacgtagcgtaacggtcgttaccgtcgtacttcgggtacggcgggtaacgacgacgtacaccgaagaccgtgngtacgacgtccgtanaccngttcctaagtcccttagccgttacctccgnttcncgg

SEQ ID NO: 5355 - DNA, 859 bp, Homo sapiens
  misc_feature: GYAE6OF01CADL3.8.28.C06.1.454.CMB.1.raw
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtcctccggtcaccctgttctttcggtttttccggnggggagagacgccctaccctctccgtgtcgccggacctagtacgaggacggtacggtaacgggtaactaaacgttgccgttaggtactccgaggacgaggacggtccgtcggacccgtaacggccctacccgacgtaccctcctacgtactttcggttcgtaccgttaccctttaacggacgggtacctaggtacgaacctacccgacgtaccggtaggtccggaacgcggtacgtacgggttcggtcggttacggggtacctttccggtactaccttaccgtaaaccctaccttaaactaaaccggtaaaccttaacccgaggttaaccctaaacttaccggtttaccggtaacggttttaccctttaggtttaaccgttttaacgttttttacgttaccgtttaggtaaccgtacgttacggtacgttaacggttaacggtaaccggttaccgttacccgggtttcccgttttaaacggtacccggggttttacccggggaaccggggtaacccggggttaaccgtaacggggttaaccccggtaccgttaaaaccggaaacggtttccggtggtacccgtaccgggttccaaccgtttccggtacgttcgtttacccgtacttccgttaacttcccgtaccctctaggtacccg

SEQ ID NO: 5356 - DNA, 594 bp, Homo sapiens
  misc_feature: GYAE6OF01EXBEW.8.28.C06.1.454.CMB.1.raw
  modified_base (177)..(177): a, c, t, g, unknown or other
  misc_feature (177)..(177): n is a, c, g, or t
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (395)..(395): a, c, t, g, unknown or other
  misc_feature (395)..(395): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagacgatcattggagaagtggtgatgacacagtctccggtnaccctgtctggtttttccngggganagagccaccctctcctgtcgcggccagtcagngcttagggacaactttagccttggtatcagcagagcctggccaggcctccagactcctctactcgtttaggcgtaccgttttaacgaggggtcccaggtaggaacttcccagcctaggttccagtcggctaggtcgggtactggggtacttcgtcgactcncgaccatacaatacctgactatctgacgtntttggctagtttatttntcgtcagtcagtcgtgaatcgtgtccgttcgtacgttcggcggtacgggacgtaacggtcgaacctacgtaacgaacgttgacgggtctacggtccaaccgtacgttcgttaccgttacgttccgtacttccccgttccgccgtaacttcgg

SEQ ID NO: 5357 - DNA, 609 bp, Homo sapiens
  misc_feature: GYAE6OF01ATKZ9.8.28.C06.1.454.CMB.1.raw
  modified_base (166)..(166): a, c, t, g, unknown or other
  misc_feature (166)..(166): n is a, c, g, or t
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacanagtctccggtcaccctgtctgtttttccnggggagagagccaccctctcctgtgccggcagtcagagcgttaggacgaacttagcctggtatcagcaggaggccgtggccgacggctcccagactcctcattcgtttggcctcctttaacgacgggccaggtaggaactcccagccgtaggttcacggcggcaggtgggtctgggacttcggtcactctacactatacaaatacctgactaatctagacttactttgacttagtttcttacgttcgtacacgtctacgttctagtaacgtcgtacggttccgttaccgtacggtttccgggacggggtaacggtaccgtaagggtccggtaccgtaacgtaacgtacgtagtcgggacgtcgtaccaccgtatccgttacgttccttactacttcccgtcccgtcgtcttacg

SEQ ID NO: 5358 - DNA, 984 bp, Homo sapiens
  misc_feature: GYAE6OF01C1VPU.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgtttttccgngggganagagccctaccctctccgtggtcggccggaccagtcgaaggtacggtaccggtttaacgggaaccgtaaacgtttacggaccgttaggggttactacgaacggccgtaagggaccgggtcccggttacggggaccccgaacgggtcccttaccccgaaacggtaaccccttccccgttacctaacgttttccggttttaccggacccggtttaaccccgttttaaaacgggaccggggtaccccgtaacgggttaccgggtaaacccttcccccggaacggtacccggttaacgggtttccgaacggggtccgggtaaccgttaaggggttccgggggttccgttacgggggtaacccttttcgggttaaccctaccgttccgtaaccctaacccgttaagtaaccctaaaaacgtttacccgtacggaccttaaacgttccgtaacgggtaaccgtttacgttttacggtaaccgttttaaggttttaaccttttcggtacgttaccgaacggtaccgttacggttaccttaagggtaaccggttaaccggttcgggttacccgtttaacgttaccggggtttaccggggacgggtaaccggggaccgtaaacggggttacccgtaaccgttaaacccggtaaacggtaacgggttacggtaccgggtaccggttccggtaacccctaaccgttacgttacccggttttaccggtttacccgttttaccccgtaacccgttttccccgttaacccccgggtaccttaccgttaaaccccggg

SEQ ID NO: 5359 - DNA, 590 bp, Homo sapiens
  misc_feature: GYAE6OF01CNHUO.8.28.C06.1.454.CMB.1.raw
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (418)..(418): a, c, t, g, unknown or other
  misc_feature (418)..(418): n is a, c, g, or t
  modified_base (546)..(546): a, c, t, g, unknown or other
  misc_feature (546)..(546): n is a, c, g, or t
  modified_base (562)..(562): a, c, t, g, unknown or other
  misc_feature (562)..(562): n is a, c, g, or t
  modified_base (585)..(585): a, c, t, g, unknown or other
  misc_feature (585)..(585): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggganagagcccaccctcncctgtgcggccagtcagagtcgttaggaacgaacttagccgtggtatcgagcaggacggcctggccaggcctcccaagacctcctnattcgtttcggcgtcctttaaacgngggccaggtcgactccccgagcccgtaggttcaggcggcaggtgggtctggggtaccttcgtcacgtctacacctataccaaataccgtnactaactctacgtacgtactttgactttagtttaattcgtcgtcacgtctagtctaagaacgtcgttggtccgttacgtacggtttcgggacgggtaggaaccgtaaggtcgactaacgaaacgtacnggtagcgtcgactacngttctgtcttacacttcctcccntctcg

SEQ ID NO: 5360 - DNA, 588 bp, Homo sapiens
  misc_feature: GYAE6OF01DZLW8.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaacttagcctggtatcagcagaggcctggccaggctcccagactcctcatctttggcgtacctttaacgagggccaggtggaactccccagccaggttcaggcggcaggtgggtctggggacttcgtcactctcaccatcaaataccctgactaatctgacgtactttagcttagtttacttctcgtcacgtctagtctaggaacgtaccgtcggtccgttcgtaccgttttcgggacgggtacgggtaccgtaagggtacggacccgtaacgaaacgtaacgtggtacggctcggacctacctagtcgttacgttccttactacttccctcccgtcctacgtccg

SEQ ID NO: 5361 - DNA, 737 bp, Homo sapiens
  misc_feature: GYAE6OF01BW2GT.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctcccagagatcattggagaagtggtgatgacacagtctccggtcaccctgtcttgttttcngggganagcgccaccctcncctgtgccggccagtcagacgtcgttaaggacgtaacttacgcctggtactcagcagacggcctggccaggcctacccgagtacctcctactagtttccgtttcgggacccgttaccgttttaaaccggacggggtccctaaagggtcgggaaaccttccccgaacgggtccgtaacggggttccaacgggtcccgggacgttaagggttcgggggttaccggttgggggtaacccttttcgggttaccaccgttacctacccgaacgtacttaccgtaaaactaacccgtcggactaactccgttacgaccgttatttcggacttagttttacttcgtacgtactaggtcctacgtactaggaaacgtccgtacgttaccgttcgttaacggtttcgggaccgggtacggtaccgtaagggtccgaacccgtagaaaccgtacgtggtcggtacctggcccaaccgttgttacccgttaggttcccttacacccgtttcccgtccccgtacttctaccggg

SEQ ID NO: 5362 - DNA, 811 bp, Homo sapiens
  misc_feature: GYAE6OF01DNGRZ.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattggggtttgggggaggaactgctcagttaggacccagacggaaccatggaagccccagcgcagcttctcttcctctgctactctggcctccagagatcattggagaagtggtgatgacacagtctccggtcacccttgtcttcgtttttcgnggggagagacgccctaccctctccgtgtcgccggaccagtccaggacggtacggttaagggaccgtaaactttcggccgttggtactcgaagccgaaggccggtccgtcgggacccgacggtccctacccaagtaccctcctacttacgtttccggtttcggacccgttacccgtttaacgggacgggtccgtaaggtacggtaaccctcccgacgtacccgttacgggtacacgggccgacggttagggtcgggtcgttacgggttactttcggtacctaccttcgtaccaacgtactaaccaaacgttaacccgtagtacctactacggtactaaccggttatttcgtacttttaacgttttcttacgttccgttagaaccgttactacgttattaaccggagttaacccgttcggggttacccttttcgggttaacccgggtttaccgggggaacggggttaaccgggaaaccggtttacccgggtaacggtaacccgtaaaccggtaaacggttaccggtacgggtacgtaccggtccggaacccttagtacccgttagtcccgtttaaccttcctaccgtttacccggtccccttcgttactcccggg

SEQ ID NO: 5363 - DNA, 896 bp, Homo sapiens
  misc_feature: GYAE6OF01DM9YS.8.28.C06.1.454.CMB.1.raw
  modified_base (162)..(162): a, c, t, g, unknown or other
  misc_feature (162)..(162): n is a, c, g, or t
  modified_base (212)..(212): a, c, t, g, unknown or other
  misc_feature (212)..(212): n is a, c, g, or t
  modified_base (299)..(299): a, c, t, g, unknown or other
  misc_feature (299)..(299): n is a, c, g, or t
tcagctcgcgtgtccacgaccggtgctcgatttagagctcacgtattgggtttgggggaggaactgctcagttaggacccagacggaaccatggaacgccccagcgcagcttctcttcctcctgctactctcggcctccagagatcagttggagaagtggtnatgacactaggttcctccggtcacccgttgttccgtttggtttttccggnggggagacgacgccctaccctcttccgtggtcgccggacctagtcaggacgtacggttaaggaaccgtaacgttcgcgttaggtacnccgagcgaacggtccggtaccgtcggacccgtaacggtccctaaccccggtaagtaccctttccgtacttacgttttaccggtttcggtaaccccgttacccgttttaaacggaaccgggtccgtaaacgggttaccgtaaacccgtccccgtaacggaccggttaacgggtaccaacggggccggttaaccggtaaggttccgggggttcggttaccggggttaccttttccggtaccccttaacgttccctttaaccgaaaccctttaacctaacgtaaaccttacccgtagtaaccgtaacgttccggtaacgttaccgtttacgtttacgttacgtttagtttactttcgttacgtacgtacgtacgtacggttacgtacggtaaacgttccggttaccggttaccgttaccggttaacgggtttaccggggacgggttaaacccgggaaccgggttaacgtaacccggtaacccgtaagtaaaccgggtacgtcggttacggtaccgtacgtacccgtaactttcgtccccgtttacgtttacccttaaccgttacccttacccgtttacccccaagtttccgtaaacccgg

SEQ ID NO: 5364 - DNA, 839 bp, Homo sapiens
  misc_feature: GYAE6OF01CE7J2.8.28.C06.1.454.CMB.1.raw
  modified_base (362)..(362): a, c, t, g, unknown or other
  misc_feature (362)..(362): n is a, c, g, or t
  modified_base (581)..(581): a, c, t, g, unknown or other
  misc_feature (581)..(581): n is a, c, g, or t
  modified_base (786)..(786): a, c, t, g, unknown or other
  misc_feature (786)..(786): n is a, c, g, or t
tcagctcgcgtgtccacgaccggtgctcgatttagagctcacgtattggggtttgggggaggaactgctcagttaggacccagacggaaccatggaacgccccagcgcagcttctcttcctcctgctactctggcctcccagtagactctagttggaagtaaggttgggtgaatgaacctacgtacgttccgtcccgggtccctaccccgttggttccttttcggttttttacccggaggggggacgaaggtccgaccccctacccgttccttcccggtaggtccggacccgggtacctacggttacgaagggtacgttacgggttaacgggaaacctaaccgtttcggaccttagggtacncgacgcgaaggtacggcgtcggaccgtaccggcctacccgaagtccctcctctacgttcgttccgtaccgtaccgttaacgcggaccgtaggtaacgtaccgtacccgacggccgtaggttacccggacggtcgggtaacgtgggttcgggttaccgttacgggttacctttccggtacctacccgtacctaccaaccttacctaaactaaccctaacnccgtaactacgttccgtaagttaccgttacgtttaacgtatttacgttttcgttattcgtacgtagtacgttacgtacggtacgtacggtacgttaccgggttctttaccggttcggtaaccggggacgggtaaaccggtacgggtaacgtccggtaccgtaaaacgtaaccggtacgtccgggtatacgtaccggacttaccgngtttcccgtaagttcccgttacctacgttccccgttccgtccgtcgtaacccg

SEQ ID NO: 5365 - DNA, 622 bp, Homo sapiens
  misc_feature: GYAE6OF01CD9GR.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (362)..(362): a, c, t, g, unknown or other
  misc_feature (362)..(362): n is a, c, g, or t
  modified_base (415)..(415): a, c, t, g, unknown or other
  misc_feature (415)..(415): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgaatgacacagtctccggtcaccctggtcttgttttccnggggangacnccaccctctcctgtcgcggccaggtcagagtcgtaggactaattagcctggtacnagacngagctgccagctccagctcctgatcgtttcgccgtctttaacgagggaccacggtaggaacctccctaacgcccgtaaggttcgacggtcggacgnggtcggtcgtggggtaaccttcgtcacttcctacaccctataacaattaaccngacaacgtctgtaccgtactttgtcttagttttacgtttctagtacaacgtcgtacgttacgtagaacgtacgtcggttaccgtttcgtaccggtttccgggacgggtaacggtaccgtaaggccgtacccgtacgaaacgtcgtagacggtcacgtactacgacttccgtattacctacgttacctcccgttcccgctagtacccg

SEQ ID NO: 5366 - DNA, 587 bp, Homo sapiens
  misc_feature: GYAE6OF01EZ37P.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttgcctggtatcagcagaggcctggccaggctccagactcctcattctttggcgtcctttaacgagggccaggtggaactcccagccaggttcagcggcaggtgggtctgggacttcgtcactctcaccatcaatacctgacaatctgacgtactttgacttagtttactttcgtagtcagtctagttctaggaagtaccgttcgggtaccgtttacgtaccgtttccgggacggggtaacgggtaaccgtaagggtacggaacccgtacgaaaacggtacgtggtacggcgtcgaccacctcttctgttcctttctacttcccttccccgcctgttaccg

SEQ ID NO: 5367 - DNA, 685 bp, Homo sapiens
  misc_feature: GYAE6OF01A3SYB.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (678)..(678): a, c, t, g, unknown or other
  misc_feature (678)..(678): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccaccctctcctgtgcggccagtcagagcgttaggaccgtaacttagcctggtatcagcagaggcctggccaggcctcccagtacctcctacattcgttttacgggcctacccgtttaaacgcggggtcctaaggtacgggaaaccttccccgaaggtcccgtaagggttccgaacggccgggtacgtacgggtcggggttaccgtagggggtacccttttccggttaccctacttccgtaccaacccgtaattaccaaaacttaaccgtggacctaagtccgttagaccgttaactttggacttagttttactttcgtagttaccagtcttagtctaggaacgtcgtcggtcgttactccggttcgggacggtacgggaaccgtaagggtccgtaccaacgtaaacgtccgaggttacggctacggaccaacgttcgtacgttcgtacccttctactcccgtttcccgngtctacg

SEQ ID NO: 5368 - DNA, 904 bp, Homo sapiens
  misc_feature: GYAE6OF01DC4LV.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattgggagaagtggtgatgacacagtctccggtcacctgtcttgtttttccgngggagagacgccaccctctcctgtcgcggccagtcgagagtacggttacggacgtaacttagccgtggtatcgagcgaaggacggcctcgggaccacggtcctacccgacgtacctcctactagtttccgtttcggaccgttaccgtttaaacggacggggtaccaggttacggaaccttcccggaacgtaccccgtaggttaccgacgggccggtacgtacgggtttcggggtaccggttacggggtaccttttaccggttaccctaccgttaccgttaaccccgaacctaaactaacccgttaaaaccgttaaacccgtcggtaaaccgttaacgttcccgttacggtaacccgtttaaccgtttacgttaccgttttaacgtttttaacgtttacgttcggttacgtacggtaccgttacggttaccgttaacgggtaaacgttaccgggtttaccgggttaccccgttttaaccggtttaacccggggttttacccggggggaaacccgggggtaacggggtaaacccgggttaaccggggttaacccgggtaacccgttaaacggaaaaacccggttacgggttaccgggtaacggtcccgttaaccgtacccggtaacccgtttacgttacccggtttaccgtttacccttaccggtttacccttccccgtttaacccccggtccgttaccgtacccggg

SEQ ID NO: 5369 - DNA, 930 bp, Homo sapiens
  misc_feature: GYAE6OF01DY72S.8.28.C06.1.454.CMB.1.raw
tcagctcgcgtgtccacgaccggtgctcgatttagagctcacgtattggggtttgggggaggaactgctcagttaggacccagacggaaccatggaacgccccagcgcagcttctcttcctcctgctactctggcctcccgagagatcagttgggaagtaaggtggtagatagaccacgtacgttcccgtcccggtcctaccccgttggtttccgtttttccggttttttccgggaggggggaacgacggtacccgtaccccctaaccccctttccgttcccgttgggtccggacccgggacctacggtacgaggtaacggttacgggttaacgggtaactaaccggttacgtccggttaggtacacgacggacgtacgggtaccggtccggtcgggaacccgtcgggtaccctacccgtaacgtaacccttaccttacgttacggtttccggttttccggggaacccgtttaaccggtttaaccgggaccgggggtaccctaaaggggttacccggaaacccttacccgggtaaccgtacccgggttaacggttccggaccgggtacggggtacgttacggggtttcggggttaacggtttacgggttaccgttttccggtacctaacctttccgaccctaaaccgtaactttaaaccgtaaacctaaccgttaggaaccttacgttcgtaaccgttaccgttacttttacgtaacgttttaacgtttttcttacgttacggttacaacgttaccggttagttaccgtaacggtaccggttacggttcccgggtttcgttaccgttacggttccggggaacggtaacgggtaccgtacgggtaaccgtacgtaaccgaacgtaggtcggcgtaacgtctaccgtcttcgtaccttcgtccttacttccctacccgttctacgtgtccgg

SEQ ID NO: 5370 - DNA, 623 bp, Homo sapiens
  misc_feature: GYAE6OF01EXOZR.8.28.C06.1.454.CMB.1.raw
  modified_base (208)..(208): a, c, t, g, unknown or other
  misc_feature (208)..(208): n is a, c, g, or t
  modified_base (249)..(249): a, c, t, g, unknown or other
  misc_feature (249)..(249): n is a, c, g, or t
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (461)..(461): a, c, t, g, unknown or other
  misc_feature (461)..(461): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagtttcagataccaccggagagattgtgttgacacaatctccagccacctgtcttcgtctccgaggggaacngccaccctctcctgcagggccagtcagatgttggcgaccgntacgtactccgtacggtaccaacgacgaaccgtcggccgacgcctacccgaccggcccctacnaacntctagntggtcgactactaccaacgacgggacctacgtcggactaccgtaccgacgaccgtacggtacgaggtcggacgtagggtaggtaggtacgggacgtacgtacttactactacctacacctactacaactactacgactnaactacgtacgncncgtttacgttttacgtacgttacgttttacgtttacgttacgttacgtacgacgtacgttcgtacgtacgtacgttcggtccgttacgtacgttacggtacggacggtacgaacggtacgtaccgtacgaacgacgtcgtcgtcgtcg

SEQ ID NO: 5371 - DNA, 821 bp, Homo sapiens
  misc_feature: GYAE6OF01BPIZL.8.28.C06.1.454.CMB.1.raw
  modified_base (196)..(196): a, c, t, g, unknown or other
  misc_feature (196)..(196): n is a, c, g, or t
  modified_base (809)..(809): a, c, t, g, unknown or other
  misc_feature (809)..(809): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgccaccctctcctgtcgccggccagtcaggagtcggttaaggacgtaacttagcctggtaactcgagcgaggacggcctggccgaggcctcccgagacctcctctattcgtttcgggccgtacctttaaacggacgggtccctaagggttacgggaaacctccccgaacggtccgtaacggggttccaacgggtccggacggtagggttccgggggttacgtacgggggttaccttttccgggttacctaacccttccgtacccaaacctattaacctaaaaaccttaacccgtgtaaccctaacttccgttacggtaaccgtttaacttttacggtaactttaacggtttttattttaccgttaggtttaaccaggttaccgtaaaggttttacggtaacgtaaaacgggtttccggttacggggttacccgttttaacgttaaccgggttttccggggggaaccggggtaaacgggggtaacccgtaaacggggtacccggtaaccgtaaaccggtaaaacggtacgtcgggtacggtaccgttcggaaccctaccgtacgttccgtttacgttccttacctacgtttcccgtaccccgtntacgttacccgg

SEQ ID NO: 5372 - DNA, 760 bp, Homo sapiens
  misc_feature: GYAE6OF01EE4FP.8.28.C06.1.454.CMB.1.raw
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtccacccgttgtcttgtttttccgngggganacgcgccctacccttctccgtggtacgccggcctagtcagacgtacgtaacggacgtaacgtcgccgttggtactcgagcgaggacggtcccgtcggaccgacggtccctacccgacgtaccttcctacgtacgtttccgtttacgggacccgttaaccgtttaaacggcgggtcctaaggtacgtaacctcccgagccgtaggtacgaggccgtacgtggtcgggtcgtacgggtacttcgtcgaccttcacctacgtactaccaaacgtacccttgaactaacgttaccgtacgtaacgttacgtttacgtactttaacgtttactttacgtacgtactagtacgtacgttacgtaaggtaccgttacgttcggttaccgttaccgttacggttaccgggtaaccgggtaacggtaaccgggtaggtacccgtaacgtaaccgtaaaacgtcgttacggtaccggtacgtaccgtacctacccgttacgttccgttacggttacccttaccgttacccttaccccggttacccttccgttacgttacccgg

SEQ ID NO: 5373 - DNA, 870 bp, Homo sapiens
  misc_feature: GYAE6OF01ACOQJ.8.28.C06.1.454.CMB.1.raw
  modified_base (98)..(98): a, c, t, g, unknown or other
  misc_feature (98)..(98): n is a, c, g, or t
  modified_base (851)..(851): a, c, t, g, unknown or other
  misc_feature (851)..(851): n is a, c, g, or t
tcagctcgcgtgtccacgaccggtgctcgatttagagctcacgtattgggtttgggggaggaactgctcagttaggacccagacggaaccatggaacnccccagcgcagcttctcttcctcctgtctactcgtcggcctaccgagagtatcgtagttgggaagtaaggtggtagacgtacgaaccgacgtaccgttccgtccggtacctaccgttggtttcgttttcggttttccgggagggacgtacgtaccgtcccctacccgttccgtccggttgggccggaccggtaccgtacggtacggtaacggtaccggttacgggtaacggtaaacgttacgtcggtacggtagtacacggacgtacggacggccggtccgtaccggaccgtaccgtacctaccgtaccgtaccttccgtaccgttcgttccgggttaccggtaccgttaccggtaaacggccggtacggtaaccggtacccgtaccgtaccggtccggtacggtacggtcggacggtacgggtacggttcgggttcggttaccgttacgttcgttacctaccctacgtactaaccgtactaacgttaacctaacgacttacgacttacgtacgtctttacgtcgtttactttacttacgttcttacgtactacggttacgtacggtcgttaacggtaccgttacggtcgttccggttaacggtacggtacccggggtacgggaaccggttaacggtacgttaaccggaacgtaccgtacgtacggtcgtaccgtacggtaccctaccgttaacctcggttccgttaccccgttacgtttaccgaaccccgtttcggtaaccccgtttaccgnggggttacctaaaccgggg

SEQ ID NO: 5374 - DNA, 576 bp, Homo sapiens
  misc_feature: GYAE6OF01DYT7Q.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (323)..(323): a, c, t, g, unknown or other
  misc_feature (323)..(323): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagcccaccctctcctgtgcggccagtcagagtcggttaggacgtaacttagcctggtatcagcaggaggcctggccaggcctcccagacctcctctattctttggccgtacctttaacgnggggtcccaggtggaactcccgagccgtaggtcaggcggcaggtgggtctgggacttcgtcactctcacatcaatacctgactaatctagacctatttgacttagtttactttctgtacagtctagtctagaagtccgtggtccgttcgtaccgtttcgggcgggtaaggaccgtaagggtcgacctacgaaacgtacgtggtacgcgtcgaccactatcgttagtccttacacttcccttcccgctgtaccg

SEQ ID NO: 5375 - DNA, 778 bp, Homo sapiens
  misc_feature: GYAE6OF01A846S.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctccagagatcattggagaagtggtgatgacacagtctccggtcaccctgtctgttttccgnggggagagacgcctaccctctcctgtcgcggcctaggtcaggacgtcgttaggacgaacttagccgttggtaatcagcaggtacggtccgtggaccaggtcctcccgagtaccctcctctagttccgtttggacccgttaccctttaaacgccggggacctaaggttcggaaaccgttccccgtaaggtacccggttaacgggtttaccaagggtccccgggtagtacgggtttacgggggttacccgttacggggggtaaccttttccccggggtttaccaaaccgtttccccgtaacccgtaaaccctggttaaacccctaaaacgtttaaacccgtacggtaacctaacgttacgtaacggtaccgtacgtttacgtacgtttaacgtttaacgttcgttacgtacgtacgtacgtacgttacgtagtaacgtacgtacgtaccgttacgtacggtttccggacgggtaacgggtaccgtaggtacgaacccgtacgaacgtacgtcggtacgtacgtacgtacgactacgtcgttacgtaccgttacctaccgttaccctcccgtaccgtgttaaccgg

SEQ ID NO: 5376 - DNA, 738 bp, Homo sapiens
  misc_feature: GYAE6OF01BS8II.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagagcccaccctctcctgtcgcggccagtcagagtcgttaggacgaacttagcctggtatcgagcagaggcctggccaggcctcccagacctcctcacttcgtttcggccgtacctttaaacgacggggtcccaaggtcggtaacctccccgaggtcccgtacggttcgaacggcggcctaagggttcggggtcgtacggggtacctttccggtttacgtaccttccgttaccaaacccgtacttaaccgtaaaacttaacccgttagaaccgtaaacttcgtaacggtaaccggttaacttttcggactttaagttttaactttcgtacgttactacggtcgtagttacgtaggtaacgtccgttacggttccggtttaccgttacggttaccgggcggggtaacgggtaccggtaacgggtacgtacccgtaacgaaaccggtaacgttggtaccgggtcaacggtaccaaccgtacgttaccgttcgttacccgttactacctttcccgtaccccggttacctacggttaccg

SEQ ID NO: 5377 - DNA, 651 bp, Homo sapiens
  misc_feature: GYAE6OF01BICHG.8.28.C06.1.454.CMB.1.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgataacacagtctccggtcaccctgtctgtttttcctgggganagacgccaccctctccgtgtgcggccagtcagagcgttaggacgaacttgcctggtatcagcagaggcctcggccaggcctacccagaccttcctctacttcgtttggccgtacctttaacgacggtccaggtacgaactcccagccgtaggttacgaggcggcgtaggttcgggtcgtgggtacttcggtcactcctaccacctatactaaacgtacctgactaacttcgtacgtaaccgttactttgtacttaagttttactttctcgtacagtactacgttactaggaacgtcgtcggtcccttacgtacggtttccgggacgggtacgggaaccgttagggtacgaaccgtacgaaaccggtcgtcggtcggctacggaccaccttcgttccttacggttccgttaccttccgttacccgtaccccgttctaaccgttgtaaccgg

SEQ ID NO: 5378 - DNA, 958 bp, Homo sapiens
  misc_feature: GYAE6OF01AF4JU.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctcggtcaccctgtcttgtttttccgnggggagagacgcccaccctctccgtgtgccggccagtcagagtcggttacggaaccgtaacttacgccgtaggtactcgacggtcgaaggaccgggtccgtcgggcccgacgggtcccttaccccgaacgtacccttccccttaccgtaacgtttccggtttttcggggacccgtttaaccccgtttttaaaaccggaccgggggtacccgttaaggggttaaccgggtaaacccttaccccccggaacggtaccccggttaaacgggttttacccgaacggggtccccgggtaccggttaacgggggtttccggggggtttcccgggttacgggggttaccccgtttttccggtttacccgtaacccttccgtaaccctaacccgtaacttaacccgttaaaacgttaaccccggtacgtaacccgttaaacgttcgttaaccggtaccgttaacgtttttacggtacgttttaacggttttttactttccggtttacgttaccgtaacggtacgttaacgttaccgttaagggtaaaccgtccgggttttacgggtacccggtttacccggtttaaccgggtttacgggggaaccggggttaaaccgggtaccggttaaacgggtacccgggttaaaccctaacgggtaaaacccggtacggttcggacgggttaccgttaccggaccctaaccgttcgttccgtttaccgttacccttcctttaccgttccccccgtttacccgtcgttacttaccggg

SEQ ID NO: 5379 - DNA, 874 bp, Homo sapiens
  misc_feature: GYAE6OF01AYOCN.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccgngggganagacgcccacctctcctgtcgccggccagtcaggagtcgttaggacgtaacttagcctaggtactcaggcaggacggtcccgtaggacccgaggcctcccgaagcccttcccctctacgttccgttttcgggacccgttaccgttttaaacgacggggaccctaaggttaccggggaaccttaccccgaacggtcccggttaacgggtttccgaacgggtccgggtacgtaacggggttcgggggtccgttaacgggggtaccgttttccgttaccaaccgttccgtacctaaccctattaacccgaaacgttaaccctagtaaccctaagttccgttacggtaccgttacgttttacggtacgttttaacggtttttaactttcggttacggttcgtaacggttaccgtaagtttaccggtaaggtaaccggttacccggtttacgggtaccccgttttacggttacccgggtttaccgggggacggggtaaaccggggttaaccggttaaacggggtcccggttaaacccgtaacggtaaaaccggttacgttacgggtaccgggtccggttacgtaaccccgtaccgttacggttcccgttaccgtttacccgtttaaccgtaccccgttttccccggtaacccccgttacgtttaccgttaacccggg

SEQ ID NO: 5380 - DNA, 766 bp, Homo sapiens
  misc_feature: GYAE6OF01DUPK4.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagagtggtgatgacacagtctccggtcaccctgtcttgtttttccgngggganagacgccaccctctccgtgtcggccgccagtcagacgtcgttagacgtaattcgctgtancagcagacgcgtcggccagccaccanctccnctattcgttcggaccgtaccgttaacggcgggaccgtaggtacggaacctcccgacggaccgtacggttacgacggccggactagggttcgggtcgtacgggtactttcggtactacgtctaccactactactaaacttaccacgtactactcgtacgtaaccttacgtttacgtatttaacgtttactttcgtacgtacgtacgtacgtacgttacgtaagtaaacggttcgttccggttacccgttaaccggttacgggtttaccgggacggggtaaccggggtaaccggtaacgggttaaccggtaacccctaaaccggtaaaacccgggttaacgttccggggtaaccggttacggtaccgtaacccgtaacccgtttaccgtttaccgttttacccggtttcccctttaaccggttaacccttttccccccggtttaacccccggttaccgttaacgttaaccccggg

SEQ ID NO: 5381 - DNA, 630 bp, Homo sapiens
  misc_feature: GYAE6OF01ANB8K.8.28.C06.1.454.CMB.1.raw
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgtgggganagagccaccctctcctgtgcggccagtcagagcgttaggacgtaacttagcctggtatcagcagaggcctggccaggcctcccgagacctcctcattcgtttcggccgtacctttaacgagggcccaggtggaactcccgagcctaggttcaggcgcgaggtcgggtctgggtacttcgtcactccgtacacctatacaactacctgactaatcgtacgacgtacttgcttagtttacttctagtccagtactcgttcgtagtaacgtacgtacggtcccgttacgttaccggtttcgggaccgggtacgggtaaccgtaagggtacgtaccgtaccggtaaaacgacgttcggtagtaccgtccgtaccaccgttacgtccgttacgttccttaccgtaccttcccttaccccgtcctaggttcccg

SEQ ID NO: 5382 - DNA, 699 bp, Homo sapiens
  misc_feature: GYAE6OF01E0J89.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgtcttgtttttccgnggggagagacgcccaccctctcctggtcgcggccagtcagagcgttaggacgaacttgcctggtatcgagcaggacggccgtggccgaggcctacccgagtacctcctctattcgtttcgggccttacccgtttaacggacggggtcccaaggtacggaacttccccgaggtacccgtagggttccgacgggccggtacgtacgggtggggttccgtacgggggttaacctttccggttaccaccgttcctacctaaccgtaacttaacaaaacttaaacccgtcgtaactaactccgtaccggtacgttacgtttacgtactttaagttttacttctggttacacggtctacgtctaaggacgtcggtccggtccgttccgtacgttcgggacggtacggggactagggacgaccgtaacgaaacgtcgtcggtacggtctaccgacctaacgtcttccgttgttcccttacgtacgttaccccttcccgactcgtaccg

SEQ ID NO: 5383 - DNA, 731 bp, Homo sapiens
  misc_feature: GYAE6OF01E0KLR.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggcaccctgtcttgttttccgnggggagagacgcccaccctctcctgtcgcggccagtcagagtcgtaaggactaatgcctggactcgagcagaggcctggaccacggcctaccgaagtacctccgtactattcgtttacgggccgttaccctttaacggacggggtaccctaaggtacggaacttccccgacggacccgtaggttccgaacggcggacgtagggtcggggttccgtagggggttaccctttacggtccctaaccgttcctaaccgtaaacctaacgtacctaaaaacgttaacccgtcgtaactaaccgttacgtacggtaaccgttaacgttttcgtacgttttaaaggttttactttcgttacggtactacgtaccgtagttcgtaaggtaacgtaccggttacggtccgttacggtaccggtttaccggggacgggtaaccggggtaaccgtaaggggtaccgaaccgtaacggaaacgtacgttggtacggcgtcgacctacctagtcgttcttacttcgtacttcccgtacccgctcgtacg

SEQ ID NO: 5384 - DNA, 885 bp, Homo sapiens
  misc_feature: GYAE6OF01EBHV7.8.28.C06.1.454.CMB.1.raw
  modified_base (145)..(145): a, c, t, g, unknown or other
  misc_feature (145)..(145): n is a, c, g, or t
  modified_base (220)..(220): a, c, t, g, unknown or other
  misc_feature (220)..(220): n is a, c, g, or t
tcagctcgcgtgtccacgaccggtgctcgatttagagctcacgtattgggtttgggggaggaactgctcagttaggacccagacggaaccatggaacgccccagcgcagcttctcttcctcctgctactcgtggcctccgagagntctagttggagtagtggagatgacacgtacgttccgtcccggtctacccgttggttcctttcggtttttaccggnggggtacgacggccgtacccctcccttccgttccgttgggccggaccggtacctaggtactacggtaggttacggtaacggaactaacgtttacgccggtagtactccgagaccggaaggtcggtcccgtcggaccccgtaggtccctaccgtaacgtcccttctaccgttacgtttccggttcggacccgtttaacccgttagggacccgggttccgtaaggttaccggtaccctcccgtagttccccggtacgggttccgaacgggggtccgtacgtacggggtttcgggtaccgtaaccgggtttcgtttaccgttccctaccgtcctaacccgtaacgtaactttaaaaccggtaactacccgttagtaaccgtaccgttacgttaccgtacgtttaacgtttcgtacgtttttaacttccgtttagttacccgttagaccggtttacgtaacgttacggttaccggtaacgttccccgggttaaccgtttccggtttaaccgttaccgggtaccgggtaaacggggtaaccggttaccgggttaacggtaaccccgtacggtaaacccgttacggtaccggtttcggacggtacgtccgtacccgtacttcgttaccgtcgtttaccttcccgtactacccgttccgacttggtaccccg

SEQ ID NO: 5385 - DNA, 748 bp, Homo sapiens
  misc_feature: GYAE6OF01AZZCD.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccaccctctccgtgtcgcggcctagtcaggacgtacggttaggaacgtaactcgccgtaggtatcgagcgaggacggcctggccacggcctacccgaagtaccctcctactacttcgttcggacctaccgttaacggacgggtccaaggtacggaacctaccccgtaggaccgttaggttaccgaacggggccgtacggtacgggttcgggggtcttacggggtacctttacggtacctaccgtacctaccgaactataaccaaacttaacctgaactacgtacgtacgtacgttactttagtacgtttagtttacgttcttacgtacacgtacgtagtacgtaagtaacgtacgttaccgggttcctttacgttaaccgggtttacggggacgggtaacgggaaccgttaacggggtaccgtaacccgtaacggtaaacgtaccggttaggtacggtaccctacggtacctaaccccgttattaccgttaccgtttacctaccttacccgtttacccctaccccgtgttacctaccgg

SEQ ID NO: 5386 - DNA, 802 bp, Homo sapiens
  misc_feature: GYAE6OF01AVV4P.8.28.C06.1.454.CMB.1.raw
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (724)..(724): a, c, t, g, unknown or other
  misc_feature (724)..(724): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctccagagatcattgggagaagttggtagatgaccactagtcctaccggtcacccttgtcgtttcgtttttccgngggggancgtacgcccgtaccctctcgtggtcgccggacctagtcaggacgtaccggttaggaccgtaacttggtccgttaggtatcgacgtcgaacggtaacgggtcccgtacgggcccgtacggacccgttacccgaacggtacccttccgtaccgtaacgttttcccggttacgggttacccgtaaccccggtttttaacggcgggtaccgtaggttaaccggtaaccgtcccacgggtaccgtacggttcggacggtccggacggtaacggttcggggtacgtacggggtaaccttcgtttacaccgttccactaaccgtagtaacctaagtccgagtacctaagtcgtaactaccgtacgttctacgttagtttactcgttacgtactacggttactacgttaccgtaagtaacggttacgttccgggttacccgttaggttaacccggttagggaccgggtaacggtaccggttaaagggtccgtaaccggttaccaacgggttaccggnggttacgtacgccgtacgttactaccgttcgttacccgtcgttaacctcgttaccccgtacccgtgttagtaccccgg

SEQ ID NO: 5387 - DNA, 782 bp, Homo sapiens
  misc_feature: GYAE6OF01C18IJ.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctccagagatcattggagaagtggtgatgacacagtctccggtcacctgttctgtttttccgnggggagagagcccacctctcctgtgcggccagtcaagagcgttaggacaaacttgcctggtatcgagcgtaagcggcctaggccaggcctcccaaggtacctcccgtctagttccgttttcggcgtacccgttttaaacgcggggaccctaggttacgggaaccttccccgacgtaccgtaacgggtttccgaacggtccgggaccgtagggttcgggggttaccgtttacgggggtaccgttttccggttacctaaccgttccttacccgaacccgttaattaccctaaaagtttaacccctagggaacctaaacgtttccgtaccggtaaaccgtttacgttttacgggacttttaacggtttttaacttttcgttaacggttctaacggtccgttagggtcccttaaggtaaacgttccgtacgggttcccgttacgttaccgggtttacgggacgggtaacgggaaccgtagggtaccgtaccgtaaaccgaaacggtactaggttacgggccttacgacccaaccgtgttccttacggttaccttacgtaccgttcccttaacccggcccttaacgttaccgg

SEQ ID NO: 5388 - DNA, 1172 bp, Homo sapiens
  misc_feature: GYAE6OF01C3HQO.8.28.C06.1.454.CMB.1.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgttcttgtttttccgngggganacgacgcccaccctctccgttggtacgccggaccagtcgagacggtacggttaggaaccgtaacgttacggccttggtactcagtacgaaggacggtacccgtggaccctacgggccctacccgagtaaccctccgttacgttactttaccgttttcggggacccgtttaacccgttttaaaccgggaccggggtaccctaacggggttaacgggtaacccttacccccggtacggtaccccggttaaaggggttcccggaacgggtaccccgggtaacggtttaacggggtttccgggggtttaaccgtttacgggggggtttaaaccccttttttccccgggtttactaaacccccggtttccgttaaaccccgtaaccccgttaaaacgtttaaaaccctaaaaaaccccgttttaaacccggtaaccggtaaacccgtttaaaacccgttttacccgggttaaacccggtttaaaccccggtttttaaaccggttttttaccgggtttaaaacccggtttttttaacgggttttttttaaaccttttttaacccgggtttaaccggtttaacccggtttaacggttacccggtttaaaccggtttaaccggtttaacgggtttaaaaacccggttaccccgggttttccgggggttttaaccccggtttttaacccggttttaacccgggggtttttacccgggggaaaccggggggttaaccccgggggtaaaccggtttaaaccgggggtaacccgggtaccccggtttaaaaccgggtaaaaacccccgggtttaaggttacccggggtttaaaccggggtcccgttaacgtaaacccccgggttaaccccgttaaccgttttacccggtttaccggttttaaccccgttttaccccggtttaaccgttttcccccccgttaaaaccccccgggttccttttaaacccgggttaacccgg

SEQ ID NO: 5389 - DNA, 703 bp, Homo sapiens
  misc_feature: GYAE6OF01BYCVD.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagttggtgatgacacagtctccggtcaccctgtcttgttttaccgnggggagagacgccaccctctcctggtcgcgccagtcaggagtcggttaaggacgtaacttgccgtaggtatccagcaggacgccgtaggccgacggctccagtacctcctactcttcgtttggaccgttaccttaaacgagggtacctagtacggaactcccgacgaccgtacggttcgacgggtacgacggtaggttcggggtacgtcggggttaactttccgttcgtaaccttccgtaccgtaccctaacgttaaccgtaaacttaaccgtacggtacctaagttacgttacggtaaccgttacgtttagttacgttaagttttactttacgtcgtacgtacgtccgtaagtctagtaacgtcggttcgtaccgttcttaccggttcggtacgggacggtaacggtacggtacggtaacgtaccgtaaaactacggtacgtaggtcgtacgtacacgttctccgttgttccgtacaccgttcctaccggtacctcgttaacgg

SEQ ID NO: 5390 - DNA, 784 bp, Homo sapiens
  misc_feature: GYAE6OF01E2LCM.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctacctctggctcccagagatcattggagaagtggtgatgacacagtctccggtcaccctgtcttgttttccgtggggagagacgccaccctctcctgtcgccggccagtcagacgtcggttaacggacgtaacgttacgcctaggtactcgagcaaggacggtccctcggccgtacggcctacccgacgtacctcccgtactacgttccgtttcggaccttaccgtttaacgacgggcctaggtacggtaactccccgacgccgtacggttccgacggccggcgtaagggtcgggttacgtcggggttacctttcgttaccgtacccttcctaccaacccgtaagtaacccaaaacgttaaccccgtagttaacctaaaggggttcctaacggtaaccgttaccgttttacgtaccgtttaacgtttttactttaggttacctcgtaacgtcgttaacgttaccgtaggtaaacgtaccgttacgggttacccgtttacggttacccggtttacggggaaccgggttaaccggggtaaaccggtaacgggttaccgtaacccgttaaacgtaaaccggtacttcgggtcgacgtcggtaaccacctcgttaccgttcgttaccctttacaccgttacccgtaccccgtcgtacgttccgg

SEQ ID NO: 5391 - DNA, 661 bp, Homo sapiens
  misc_feature: GYAE6OF01BWJWT.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttccccctgctactctggctcccagagatcattggagaagtggtgatgacacagtctccggtcaccctgtcttgtttttccgtggggagagagccaccctctcctgtgcggccagtcagagtcgttaggacgaacttagcctgggtatcagcagacggccgtggccacggcctccacgcctcctcacttcgtttcggccgtaccgtttaacgacgggcctaggtcggaactcccgagccgtaaggttcaggccggcgtaggtcggtcgtgggtacttcgtcactctcactatcaacgtacctgactaatcgtagactacgtttgacttagtttattcgtcgtacacgtctacggttactaggaagtcgtacggttccgttacgttaccggtttaccgggacggggacgggtaacccggtaagggtaccggaaccgttaaccggtaaacggtacgttacgggtacggtccgtacggacctaaccgtacttcgttaccgttccgtttacctcgtttccccttacccggtacccttacgtaccgtaaccgg

SEQ ID NO: 5392 - DNA, 741 bp, Homo sapiens
  misc_feature: GYAE6OF01BE5UH.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (491)..(491): a, c, t, g, unknown or other
  misc_feature (491)..(491): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccaccctctcctgtcgcggccagtccagagcgttaaggactaacttgccgtggtatccagcgaggaggccctgggcccacggcctacccgagtacccttcctacagttccgttttcggcccgttaacccttttaaacggacggggtccctaaggttacgggaaacctccccgaagtccccgtaagggtttaccgaggccggtaccgtagggttcggggtcttacgggggtacctttcggttactaccgttcctaccaaaccgtaacttacaaaactttaccgngtacctaacgttcgtacgtaccgttactttggtactttacgttttattcgtgtactaacgtcgtaactcgtagtaacgtcgtccggtacttcgtaccgttcggggacgggacgggtaaaccgtaggtaccggtaacctaacgggtaaacgtaaccggttggtacccgggtcgtacccggaaccttaacctggttcccttaccggtttactttaccgaccctttccccttcccccgaagttaccgtaccgg

SEQ ID NO: 5393 - DNA, 667 bp, Homo sapiens
  misc_feature: GYAE6OF01BLN7Y.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgtcttgtttttccgnggggagagacgcccaccctctcctggtcgcggccagtcagagcgttaggactaacttagcctaggtatcagcgaggacggcctcggaccgacggcctcccgagaccttcctacattccgtttcggaccgttacctttaacgacggggtaccaggtacggaaccttccccgagtcccgtaggtcaggccggacgtaggtgggtccgtgggtacctttcggttaccaccgttcctccgaacctactacctaaacgttaaccgtcgactaacttcctacggtaaccgttacgtttcgtactttagttttactttcgtcgtcaggtcctagtctaggtacgtcgttcggtcgttcgtaccggttcgggacgggtacgggaccgtagggtaccgtacctaacgtaacgtacgtggacgtcgtcgtacccactctccgtcgttccttctacctttcccgtaccctcgtagttccg

SEQ ID NO: 5394 - DNA, 650 bp, Homo sapiens
  misc_feature: GYAE6OF01AKMX6.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttcgtttttccngggganagagcccaccctctcctgtgccggccagtcagngcgttaggactactgctggtatcagcaggacggccgtggaccgaggcctcccagacctcctctacttcgtttcggcctccgtttaacgacgggtcctaaggtacggaactccccgacgtcccgtaaggttccgacggccggaccgtaggttcggggtcgtacggggtacctttccggttcgtaccgttcgtacaccgtacttaccaacttaaccctgactaactcgtacgtaccgtacgtttgacttagttttctttacgtctcgtacgtctagttcgtagtacgtacgtcggtcttcgtacgtttcggacggtacggtacgaggttaccgacttacgaacgtacgtggtacggtacgtcgtacctactacggttctcgttcttaccgtactacccgtttcccgccttagtccg

SEQ ID NO: 5395 - DNA, 831 bp, Homo sapiens
  misc_feature: GYAE6OF01BBFPG.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgtcttgtttttccgnggggagagacgccctaccctctcctgtgaccggccagtcagagtcgttaggacgtaacgttacgccgttaggtaactcgacgcgaaggacggtcccgtggacccgaggccctacccgaaggtacccttcccgtactagtttccgttttcggacccgttaacccgtttaacggacgggtacctaggtacggaaccttcccgaagcccgttaggttccgaggccggtacgtagggtcggggtacgttacggggtacctttaccggttcctaaccttccgtaccaacccttaactaaccgttaaacgttaacccgtggtaacctaacgttccgtacggtaacccgtttacgttttacgtacgttttaacgttttacgtttacgttgtacgtacgtaccgtaacgtttaccgtaaggtaaccggttacggttaccgggttacccgttaccggttaaccggtttccgggggaacgggtaaacccggggtaccggtaaacgggttacccggtaacccgtaaaaccggtaaaccggtaacggttccgggttacggtacccgtaggtaccctaaccgttccgttcgttcgttacccttacgttaccccgtttaccccgttcccgaccgttacggttacccg

SEQ ID NO: 5396 - DNA, 796 bp, Homo sapiens
  misc_feature: GYAE6OF01ASR99.8.28.C06.1.454.CMB.1.raw
  modified_base (204)..(204): a, c, t, g, unknown or other
  misc_feature (204)..(204): n is a, c, g, or t
tcagctcgcgtgtccacgaccggtgctcgatttagagctcacgtattgggtttggggggaggaactgctcagttaggacccagacggaaccatggaagccccagcgcagcttctcttcctcctgctactctggctcccagagatcattggagaagtggtgatgacacagtctccggtcaccctgtcttgttttccgtggggganagacgcccaccctctcctgtcgcggccagtcagagcgttaggacctaacttgccgtaggtatcagcagacggcctcggccaggcctacccagacctcctctacttcgtttcggccgtacctttaacgacgggtcctaaggtacggaacctccccgaagcccgtagggttacgacggacggtccgaaggttggggttccggtacgggggtaacctttcccggtttaccgaacttccgtaacccgaacccgtaattaacccgtaaaaacgttaaccctcggtaacccttaaagtccggttacggtaaacccgttaacttttcggaacctttaacggtttttactttccgttagttacccgtaagtcctaagttacccgtaggtaaacgttacgttaccgggtcctttccggttaaaccggtttccgggaacggggtaccgggtaaaccgttaacggggtccgtaaccctaacggtaaaacgggttaccgtagggttaaccgtaccggttaccggaccttaaaccgacgtttccggttaccgtttacccgttacgtaacccgttacccccgtttaccccgtcgttaacttcccgg

SEQ ID NO: 5397 - DNA, 793 bp, Homo sapiens
  misc_feature: GYAE6OF01CZ1NQ.8.28.C06.1.454.CMB.1.raw
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatagacacgtagtccgtccggtccaccctgttcttgtttttccgnggggagacgacgccaccctntcctgtcgccgcagtcagcgcgttaagactaacttagccttggtactcaagccgaaggacggccgtacggaccgacggtcctacccgagtccttaccctcgttaacgttccggtttaccggtaccgtaccggttttaaacggcggggtaacccgtaaggttacggaacccttaccccgaagggtacccctacgggttaccgacgggccggtaccgttaaggggttcggttacggtttacgggtcccgttttcgtacctacgtcctacgacctataccgtaaatacccgtgacctatacgtcgtacgtactttgtactttagtttacttcgtagtacacgttacgtagtacgtacgtaaacggtccttacgggtcccgttaacgttccgggttacgggaaccgggacgggttaaccgtaacgggtaccggtaacccttaacgtaaacccgggttcgttacgggtcggtacccgttcgggaacccttacgttaaccggtttcccgtttacgttttacctaccccgttttaccccgaacccttttcccccgggacttaacgggttaaccccgg

SEQ ID NO: 5398 - DNA, 733 bp, Homo sapiens
  misc_feature: GYAE6OF01AUFVD.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagacgcccaccctctcctgtcgcggccagtcagagtcgttaaggacgtaacttagccgttggtactcagcgaagacggccgtggccaggcctcccgagtacctcctctagttcgtttcggccgttacctttaaacgcggggaccctaggtcggtaactccccgaggtccgtaggttaccagggtccggtacgtaacgggttcggggtcgttcgggggttaaccctttcggtttacccgtaccttcctaccgtaaccctaataaccaaacgttaaaccctagtacttaactcgtagtaccgttagtttcgtacctttaaggttttactttcgttacgtacgtacgtcgtacgttacgtaggtaacgtaccgttcggtaccggtttaccgtaccgggttttcggggacgggtaaccggggtaaccggtaacgggttacggaacctaacggtaaaccggtacgtggtacggtcgtcgaccactacgttccgttcgttacgttcgtaccttacccttccccgtctacgtaccgg

SEQ ID NO: 5399 - DNA, 860 bp, Homo sapiens
  misc_feature: GYAE6OF01EJKU9.8.28.C06.1.454.CMB.1.raw
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaacgccccagcgcagcttctcttcctcctgctactcgtggcctccgagagatcagttggagaagtggtagatgacacgagtcctccggtcctaccttgttcctttggtttttccggaggggacgacgaccgtacccctaccccttctccgttaggtcgccggccgtagtacgacggtacggtacggttaacggaccgtaacgttgccgttagtacncgagcgtaacggcggtccgtacggaccgtaccgggcctacccgtacgtacccttacctacgttacgtttccgtttacgggacccgtttaaccgtttaacggcggtacgtaacggtacggtaaccctcgtaaccggtccggttaaggtacgacgggtccggacgttagggtcggttacggtaccgggtttcttaccgtaccttaccgtcccgtaacgtacctaacttaaccgtaaaccgttacggtaactaccgttaacgtcgttaacggttaccggtttacgttacgtttacgtttaacgttttttaccgttcgttaaccgacgtacgtacgttcggttaacgttaacggtacggtttaaccggttccggttaccgtttaaccggtttccgggtaccgggaacggggtaacggtaaccgtaacgggttacccgaaccgtaacggtaaaccgtaggttccggtacgtaaccgtcccttaaggaccttttcggtccgtttaccgttcgtttaaccccgtcctttacccgtcccgtacccgttagttaccggg

SEQ ID NO: 5400 - DNA, 753 bp, Homo sapiens
  misc_feature: GYAE6OF01BE8U4.8.28.C06.1.454.CMB.1.raw
  modified_base (200)..(200): a, c, t, g, unknown or other
  misc_feature (200)..(200): n is a, c, g, or t
  modified_base (256)..(256): a, c, t, g, unknown or other
  misc_feature (256)..(256): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctgggganagagccacctctcctgtgcggccagtcagagcgttaggactaacttagcctggtancagcgaggacggcctggccgaggcctcccgaagacctccgtcacttcgtttcggccgttaccctttaacggacggggtcctaggttacggaaacctccccgaacggtacccgtagggttccgaacgggccggtacgtagggttcggggttcggttacgggggtacctttcggttccacgttcctaccgaaccctattaaccaaaccttaccgtacgactaacttccgttacgtaaccgtttacgttttacgaccgtttaagttttactttccgtacggttaccgtagtaccgtacggtttacgtaacggtaacggtacgttcgggttacccgtttcgttaccgggtttccgggaccggggtaacgggtacccgtaacggggttcggaacccgtaaccggaaacgtacggtaggtacgggtacctacggtaccaccgtcgtccgttagttacccgttaccgtaacctttccccgtacccctaccgtacgttaccccgg

SEQ ID NO: 5401 - DNA, 770 bp, Homo sapiens
  misc_feature: GYAE6OF01D33KM.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagcgcccacccttctcctggtgccggccagtcagagcgttacggacgtaacttcgcctggtactcagcgaaggacggccgtcggccgaggcccttacccgaacgtacctccctctatttccgtttgggcccgtaacccgttttaaacggacggggtccctaagggttacggaactccccgaagtacccgtaagggttccgaacggcgggtacgtagggttcggggttcgttcgggggtaacctttccggtttacaccgttccttacccaacccgtaatacctaaaacgttaaccctagacctaacgttccgttacggtaaccgttacgttttcggttacgtttaagttttaactttccgttacgttccgtaagtcgttaacgttcgtaggtaaacgtacggttcggtacccgtttaccgtaccgggtttacgggaccggggtacggtaaacccgggaagggttaccggacccgtaaccgtaaaacggtaccggtggttacgggcgtacgtccaacttcgttcttacgtttacttcctttacccgtttcccaccttcgtgtaaaccgg

SEQ ID NO: 5402 - DNA, 734 bp, Homo sapiens
  misc_feature: GYAE6OF01CWRJS.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (322)..(322): a, c, t, g, unknown or other
  misc_feature (322)..(322): n is a, c, g, or t
  modified_base (470)..(470): a, c, t, g, unknown or other
  misc_feature (470)..(470): n is a, c, g, or t
tcagctcgcgtgtccacgaccggtgctcgatttagagctcacgtattggggtttgggggaggaactgctcagttaggacccagacggaaccatggaagccccagcgcagcttctcttcctctgctactctggctccagagatcagttggagaagtggtgatgacacagtctccggcacctgtcttggtttttcgngggganagacgccaccctctccgtgtcgcggccagtcaggagcgttaggaaccgtaacgttacgccgtaggtactagacggcgaaggtacggccgtaggaccacgggcctacccgagtacctccgtntaacgttttccgtttacggaccgttaccgtttaaacggcgggtacccagggttacggaacctcccgaagacccgtaggtacgacgcggtactagggttcgggtcgtacgggacctttcgactacgtctacgacctatacctaaatacngaactacgtcgacgtacgtacttagactttaagtttatttcgagtacaggtcaaggttcaagggtaactaccgtaccggtccggtttactaaccgggtttacgggggacggtaaacggtaacccggtaaaggggtcctaaccgtaaaccgtaaaggtacggttcgggtaacggtcctaacggtaccgtacccttaacggtttcgttaacgtttaccccttacgttaaacctttccccggttaacccggacttcggttaaaccgg

SEQ ID NO: 5403 - DNA, 706 bp, Homo sapiens
  misc_feature: GYAE6OF01D81HM.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
tcagctcgcgtgtccacgaccggtgctcgatttagagctcacgtattgggtttgggggaggaactgctcagttaggacccagacggaaccatggaagcccagcgcagcttctcttcctctgctactctggctcccagagatcattggagaaggtggtgatgacagagtctccggtcacccgtgtctttcgttttcgngggganagacgcccaccgtctccgnggtcgccgcagtcaggngtcgtaaggaccgtaatgcgtagatcgagcgaaggtcggccgtggaccacggccctacccgagtaccttcctagttaccgttcggtttcggacccgttacgtttaacggaccggtaccgtaggtacggaaaccgtccaccggtaccgtacgggtaccagggtacggacggtagggttccgggtcgtaaccggggtacctttcggtactacctacccgtacgacctataacctaactacgcgtaactacgtcgacgtactacgtttacgtacttagtttacttcgtagtcgacgtacgttgtacgtaagacggttaccgtcgttaccgttcggttaccggttacgggaccggggtacggaccggtaagggtacccgaacgtacgtaaaacggtcggtagtccacgtccgtaactactgttaaccttgttacccgtactcccgttacccttccgtaccgtcgtaaccgg

SEQ ID NO: 5404 - DNA, 675 bp, Homo sapiens
  misc_feature: GYAE6OF01AGZHX.8.28.C06.1.454.CMB.1.raw
  modified_base (97)..(97): a, c, t, g, unknown or other
  misc_feature (97)..(97): n is a, c, g, or t
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
tcagctcgcgtgtccacgaccggtgctcgatttagagctcacgtattgggtttgggggaggaactgctcagttaggacccagacggaaccatggaanccccagcgcagcttctcttcctcctgctactctggctccagacgatcattggagaagtggtgatgacacagtctccggtcacccgtgttcttggtttttccgnggggganacgtacgccccacccttctccgttagtcggaccggaccaggttaccaggacggtacggttaacggaaccgtaaacgtttcgccgttaggtactacgagtacgaaggtacggccgtacggaccgacgggtcctaccgacggtacctcctaccgtagtttccgttacgggccttaacccgtttaacggacgggtcctaagggtaccgtaacctcccgacgtacgtacggttcgaacggcggtcgtacggtcgggttcgtacggtacttcgtacactctaccactatactaactacctagactatcgagtaccgtattgactttagtttactcgtagacatacgtacgtacgtagacgtatccggttctacggttacgtcgggacggacggtactaggtcgaaccaacggtactagtacggatacgtcacgtacgcttacttcgtactactactcccgtccaattcgtacg

SEQ ID NO: 5405 - DNA, 792 bp, Homo sapiens
  misc_feature: GYAE6OF01ETPT0.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctcccagagatcattggagaagtggtgatgacacagtctccggtcaccctgtcttgtttttcgnggggagagacgccaccctctcctgtcgcggccagtcagagtcgttaaggactaattgccgtaggtatcgagcaggcggccgtggccaggcctacccgagtacctctactacttcgtttcggaccttaccgttaacggcgggtaccaggtacggaacctccccgaaggtcccgtagggttccaacgggtccggtacgtagggttcggggttaccgttagggggttaacctttcggtttacccgacctttaccgtacccgtaaacccgtaaacttacccgtaaaacttaaccccgttcggtaacctaacgttaccggtacggtaaccgttacttttacggtacctttaaggttttactttcgtacgtacgtacgtcctagttaccgtacggtaacgttaccggtccgggtaccgtttaccggttaccgggtttaccggggacggggtaaccgggtaacgtaaccggggttccgtaaacccgttaacgaaaccggtacggttacggtaccggtacgtcccgtacgtaccgttacgttccgttacgttacccttacccggttacccttaccccgtttaccccgcgttacgttaaccgg

SEQ ID NO: 5406 - DNA, 882 bp, Homo sapiens
  misc_feature: GYAE6OF01E3JPQ.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgcccaccctctccgtgtgcggccagtcaggacgtcgttaaggaccgtaacttcgccttggtatcagcaggacggcctcgggccaggcctacccgaacgaccttccctactactttccgttttgggccccgttaaccgttttaaaccgacggggtaccctaaggttacgggtaaaaccttcccccgaaggtaccccgtaaggggtttccgaacgggcccgggtacgtaacggggttcggggttaccgttcgggggttaacccttttccgggtttacccaaccgttccgtccaaacccctagttaacccgaaaacctttaaacccctggaacccttaaactaccgttaacgggtaaccgttaaccgtttttcgacgtttttaaacgtttttacttttcgttacggttacctaacggtacccgttagtttacccggttaaggtaaaccggtacccggtttccgggttacccttttacccggttaaccgggtttaccggggaaccggggtaaacggggtaacccggtaacgggttaccgggtaaccctaaccggtaaaaccggttaccggttagggtaccgggtcccgtacggtaccccctaaaccggttcttaccgttccgtttaccccgtttctaacccgttttcccccctacccggttaccccgtacgttacccgg

SEQ ID NO: 5407 - DNA, 734 bp, Homo sapiens
  misc_feature: GYAE6OF01CK49B.8.28.C06.1.454.CMB.1.raw
  modified_base (194)..(194): a, c, t, g, unknown or other
  misc_feature (194)..(194): n is a, c, g, or t
  modified_base (488)..(488): a, c, t, g, unknown or other
  misc_feature (488)..(488): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccgtcaccctgtctgtttttccgnggggagagacgcccaccctctcctgtcgcggcagtcagagcggttaggacgtaacttgccgtggtactcaggcaaggacggcctggccacggcctcccagacctcctacacttcgtttggacctacctttaacgacggccaaggtacggaactcccgagacccaggttacaggcgcaggtcgggtctcggggtactttcgttcaccgtctacgacctaataccgtaaattaacctgactaactcgtacgtaactacgtttgaccgtttaagttttacttccgtcgtactacgtntacgttacgtacggtaaacgtcggttaccgggttaccgtttaccggtaccggttttaccggggaccgggttaacggggaaccgtaaacggggttacggtaaccccgttaaccgggtaaaaccgtaacggttcgggtaaacgggtcccgttaccggaaccgtaccccgttaagtacccgtttcttaacccggtttaacttacccgtttaaccccgttcccccgggtacccttaacgtttaacccggg

SEQ ID NO: 5408 - DNA, 846 bp, Homo sapiens
  misc_feature: GYAE6OF01BWO1E.8.28.C06.1.454.CMB.1.raw
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (284)..(284): a, c, t, g, unknown or other
  misc_feature (284)..(284): n is a, c, g, or t
  modified_base (783)..(783): a, c, t, g, unknown or other
  misc_feature (783)..(783): n is a, c, g, or t
tcagctcgcgtgtccacgaccggtgctcgatttagagctcacgtattgggtttgggggaggaactgctcagttaggacccagacggaaccatggaacgccccagcgcagcttctcttcctcctgctactctggcctcccagagatcattggagaagtggtgatgacacgtagtccgtccggtcacccttggttcctttggtttttccgngggggganacgacgccctaccctcgtccgtggtcgccggccagtcagcgtcgttaggactaacgttagcgtgtancgagctagcgcgtcggccgaggcctaccagtacctcctctattcgtttcggaccgttacctttaacggcgggacccgtaggtacgggtaaacctccccggagtacccggttaacggggttccgaacggggtccggtaacggtaccgggtttcgggggtcccggtttacgggggtaaccccttttccgggttaccctaaccggttccctaccgttaaccccgtaaatacccgttaaaaacgttaccccgtaggaccttaacgttccgtaacggtaaccgttacgtttacgtactttaacggttttactttacgtccggttactacggtactaggttacgtacggaaacggttcggtacggttccggttaacctaccggggttttaccggggacgggggttacccggtaaccggggttaaacgggttaccgggaaaccgtaacccgtaaaaacgggtaccgttcgggtaccgggttaccgtacggttacccaacccggttnttaccgttacggtttaccttaccgggtacctttacccgttcccctaaccggttcttaaccggg

SEQ ID NO: 5409 - DNA, 847 bp, Homo sapiens
  misc_feature: GYAE6OF01E1N29.8.28.C06.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagctcacgtattgggttgggggaggaactgctcagttaggacccagacggaaccatggaagccccagcgcagcttctcttcctcctgctactctggcctccagagatcagttggagaagtggtgatgacactagtcctccggtccacccgtgttcttcggtttttccgagggganacgacgcccctacccgttctccgtggtaccggccgggtaccagtcgagtacggtccggttaaggaccgtaactttacggccttaggtactcgacgcgaaggacggtccgtcggacccgacggtccctacccgacgtacctcctactacgttcggtttccgggcccgttaaccgttaaccggacgggtacctaggtaccggaacctcccgacgtaccggtacggttaccgacgggtccggacgggtaggttacggggtcccgtaggggttacccgtttcgtaccgtacccgtccttaaccgaacccgtaactaacctaaaccgttacctacggtaaccaacgttaccgtacggttaaccgttacgtttacgtacgttttacgtttactttcggtactacgtacgtacttagttcgtaacgtacgtaccgttaccgggttacgttaccgttaaccgggttcgggtaacgggtaaccgggtaacgggttaacggtacccggtaacgtaaccggtaaaacggttccggttcggtaaccgggttacttaccgggaaccctaaccgttaacgttcccggtttaccgttaccgtttacccttaccccgggttacccctttaccccgtccttacggttaaccggg

SEQ ID NO: 5410 - DNA, 684 bp, Homo sapiens
  misc_feature: GYAE6OF01DJZB2.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcacctgtctgtttttccngggganagagccaccctctcctgtcgccggccagtcagagcgttaggacgtaacttagcctggtactcgagcgaagacggcctggccaggcctacccagacctcctctattccgtttggccgtaccttttaacgacgggtaccaggtaggaacctccccgagcctaggttaccacggcggtacgaggttcggggtccgtggggtacctttcggtacaccttctacacctatacgtaactaaccgtgactaagtctagtaaccgtacgtttacgtacttagttttacttcgtacgtacacgtctacgtccgtaaggtaacgtacgttcggtcccgtttacgtaccggtttcgggacgggtaacgggaaccgtaacggggtacggtacccgtaacggaaaaccgtacggtacgggttcggaaccgtcggaaccacccgttactccggtttacgtcgttacctacgttccccttacccgccttaggtacccg

SEQ ID NO: 5411 - DNA, 796 bp, Homo sapiens
  misc_feature: GYAE6OF01CLA5U.8.28.C06.1.454.CMB.1.raw
  modified_base (198)..(198): a, c, t, g, unknown or other
  misc_feature (198)..(198): n is a, c, g, or t
  modified_base (480)..(480): a, c, t, g, unknown or other
  misc_feature (480)..(480): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgtcttgtttttccgnggggagagacgccaccctctcctgtcgcggcagtcagagtcgtaggacgtaacttacgctggtatcagcaggacggcctcgggcccacggtccctcccgacgaccttccctactaactttcgtttaccgggtccgttacccgttttaaacgaccgggcctaagggttacggaactccccgagcccgtaggttacgacggcggacgtaggtgggtcggtggggttacctttccggttacctaccgttcctacccgtacctaacgttaactaaaccttaaccgnggtaaccttaacgttaccgtaacggttaccgttaccgttttacgaaccgttttaagttttttactttcggttacggttacgtacggttacgttaccggtttacgtacggtaaacggttaccggttccgggttacccgttttaccgttaccgggtttccgggggaccggggtaaacggggtacccggttaaaggggtacccgtaaccggttaaaccgaaacgggttaaccgtagggttaacggccggttacgaccctaacgtcgttcccgttaacgtttcttacccgttacccttccgttaccccgccttgtacccg

SEQ ID NO: 5412 - DNA, 791 bp, Homo sapiens
  misc_feature: GYAE6OF01DNH6V.8.28.C06.1.454.CMB.1.raw
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgactgacacagtctccggtcaccctgttctgtttttccgnggggagagacgcccaccctctcctgtcgccgccagtcagagcgtagactatgctgtancagcgagacgcctggccaggcctccagtacctcctctattcgtttacggcgtaccgtttaacggcgggtaccaggtcggaacctccccgagaccgtaggttaccgaggccggtagtagggttcggggtcgtacggggttaccgtttaccgttccgtaaccgttcctaacccaccgtaaacgttacctaaaacttaacccggtagtaccgttaaacgttccgttacgggtaaacccgtttacgttttacgggtaccttttaacgttttttaaccgttttccttgggttaacccgtacgggtaccttacgggtttaaccgtaggtaacggtacccgtttcggggttaccccgtttacgttacccggggtttaccgggaccgggggtaaccgggtaaccgtaacggggtacccgtaaccgtaaccggtaaaacggtacgttcgggtacggtccgttaaccgaccctaccgttacgttccttaccgttcctttacccgtaccgttttccccttacccccgacgttacccgttaaccgg

SEQ ID NO: 5413 - DNA, 820 bp, Homo sapiens
  misc_feature: GYAE6OF01A8DAG.8.28.C06.1.454.CMB.1.raw
  modified_base (200)..(200): a, c, t, g, unknown or other
  misc_feature (200)..(200): n is a, c, g, or t
  modified_base (390)..(390): a, c, t, g, unknown or other
  misc_feature (390)..(390): n is a, c, g, or t
tcagctcgcgtgtccacgaccggtgctcgatttagagctcacgtattgggtttgggggaggaactgctcagttaggacccagacggaccatggaagccccagcgcagcttctcttcctcctgctactctggacctcccgagagatcagttggagaaggtggtgatgacacgagtctccggtcacctgtcttgttttccgngggagagacgccacctctccgtgtggccgctagtcagacgtcgtaggacgtactcgctaggtactcagcgaaggtcgtccgtcggaccgtacggcccttacccgacgtaccctccgtacctacgtttcggttaccgggtaccttacccgtttaaaccgggacggggtaccctaagggtaccggttaaccnccccggtaacgtacccggttaacgggttaccgacgggcgggttaccgtaggggttcggttccgggtacgggggttaccttttaccgggtccttacccgtctaccccgtacgtaacttaaacccggtaaacttaaccgacgtaccgttaaacctaccgttaacgggaaccctttacgtttacggtaaccgttttaagttttccgtttacgttacggtacgaacggttcgtaacgttacgaggttaaccggtacgttccggttaccgtttaccggttacgggttacgggaccgggtaaacgggttacccggtaacggtaccggtaaccttaaccggaaacgtccggttacggtcggaacgtcgaacctaccgttactaccggtttcttacccttaccgttcgtttaccccgtacccgtcgttaccgtacggg

SEQ ID NO: 5414 - DNA, 818 bp, Homo sapiens
  misc_feature: GYAE6OF01BVQ4M.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgattacacagtctccggtcaccctgtcttgtttttccgnggggagagacgcccaccctctcctgtgccggccagtcagagtcgttaggacgtaacttgcctggtactcgagcagacggcctggccaggcctcccgagtacctccctctacttcgtttcgggccgtacccgtttaacggacggggtacccagggttacgggaaaccttccccgaaggtccccgtaaggggtttccaacgggccgggtacgtaaggggttcggggttacgtcgggggtaaccttttcccggttacctaccctttcccgtaccaaccctaacgttaccctaaaaccttaacccgtacggtacctaaacgttccgtacggtaaccgttaccttttacggtaccgtttaaggtttttacttttcggttacgttaccgtaacgtacgttacgtaccgtaaggtaacgtcgttacgggttcccgtttacgttaaccggtttaccggggaccgggtaacggggtaacccgtaacggggttaccggtaaccgttaacccggaaaaccggtaacgttcgggtacggtaccgtccgtaaccgtaacccgttacgttacccgttccgttaccttacccgttacccgttccccgttaccccgtaccttacgttccgtaacggg

SEQ ID NO: 5415 - DNA, 723 bp, Homo sapiens
  misc_feature: GYAE6OF01ARKMZ.8.28.C06.1.454.CMB.1.raw
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgcccaccctctcctgtgcggccagtcagngcgttaggacgtaacttagcctggtatcgagcgaggacggtccctggcccgaggcctacccgagtaccttccctctactttccgttttcggcccgttacccgtttaaacggcggggtacccgtaggttacggaaacctccccgacggtccgtaacgggttcacgggccggacgtagggttcggggtaccgttcggggtaccctttccggtttactaccgttttaccaacccgtaacttaccgtaaaccttaacccgtgtaacctaagttccgtacgtaccgttacttttgacgtttagttttactttcgtgtctacgcgttagtctagaacgtcgttcggtccgttacgtccgttacgggacgggtaacggtacgtaacgggtacgtaaccctacgaaaccgtacgtgtaccggctaccgtaccgtacttacgttcgttccgttacttccgtaccgtttcccgtaccccgtccttacgttcgtacgg

SEQ ID NO: 5416 - DNA, 808 bp, Homo sapiens
  misc_feature: GYAE6OF01CRPD9.8.28.C06.1.454.CMB.1.raw
  modified_base (161)..(161): a, c, t, g, unknown or other
  misc_feature (161)..(161): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccgagagatcagttggaagaagtggtnatgacacagtccgtccggtccacctgtctttgttttccgnggggagagacgcccaccctctccgtggtacgccggtaccacgtcaggtacgtaccggttaacggaacgtaacttacgccgttaggtactcgaaggtcgaaggaccggtccgtacggacccgacggtaccctacccgaacgtaccctccgttacctagtttcccggtttccgggaccgttaacccgtttaaacgggccggggtacctaacgggtaccggtaacccttaccccggaacggtaccggtacgggttaccgagggccgggtcgtaagggttcggggttccggtacggggttacctttccgtaccaccgttaccgtacccaaccttagtaaacccttaaacgtacccgtagacctaacgttacgtaacgttaccgttatttcgtaacgtttacgttttacttcgtactcgtacgtacgttacgttacgtaacggtacgtaccggtcgttaccggttccgtacggttacgggtaaccggggtaacggtacgggtaaccggtaccgtaaccgtaacgtaacgggcgtacgggtcgaccgtaaccgcctaaacggtctttacggtaccttccgttacgtacccttccgtaacccgtcctactacgg

SEQ ID NO: 5417 - DNA, 678 bp, Homo sapiens
  misc_feature: GYAE6OF01BHYA9.8.28.C06.1.454.CMB.1.raw
  modified_base (199)..(199): a, c, t, g, unknown or other
  misc_feature (199)..(199): n is a, c, g, or t
  modified_base (639)..(639): a, c, t, g, unknown or other
  misc_feature (639)..(639): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaaggtggtgatgacacagtctccggtcaccctgttcttgttttccgnggggagagacgcccaccctctccgtgtcggccgcagtcagacggtcggttaacggacgtaacgttacgccgttggtatcgagtacgaggacggtccgtgggacccgaacggccctacccacgtaccttcctctacgtttccggttacgggacccttaccgtttaacggcgggacctaggtaccggaacctccgagccgtaggtccgagggccgtggtaggtcgggtcgtacgggtccgtttctctacctgtaccaacgtactaactaaacctaccgtagacctaagttccgtacgtaccgtttacgttgttactttacgttttacttcgtacgtagtacgtcagttagacggtaagtccgttcggtcgttaccgtaggttccgggacgggtacgggaacgtaacggtcggacctaacggaactacgtggcgtcgcgaccncgtactcgttctcgtctaccgttcctaccgtctcgtacg

SEQ ID NO: 5418 - DNA, 971 bp, Homo sapiens
  misc_feature: GYAE6OF01BO518.8.28.C06.1.454.CMB.1.raw
  modified_base (199)..(199): a, c, t, g, unknown or other
  misc_feature (199)..(199): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcacccttgtcttgtttttccgnggggagagacgccaccctctcctgtcgcggccagtcagacgtcgttaacggacgtaacttacgccgttggtactcgagcgaaggacggccgtaggaccacgggcctacccgaacgtacctccctactacgtttcgtttacgggcccgttaacccgtttaaacggaccggggtccctaagggtacgggtaaacccttaccccggaacggtacccggttaacgggtttaccgaacgggtccggggtaccggttaacggggtttcgggggttaccggtttaacggggggttaaccctttttccgggtttaccctaacccttttacccgtaacccgtaaacccgtaaagtttaaaaccctaaaaaccgtttaaacccgttacggaaacctttaaacgttacccgttaaccgggttaaaccccggtttaaccgtttttacggttaacccgttttaaacgtttttttaaccgttttccggtttaccggttaccgtaacggttaaccggttaacgttttaccggttaaaggtaaaccggtttacccggttaccggggtttacccgtttacccggttaacgggttttacccggggaaccggggtaaacgggtaaaccggttaaacggggttacccggtaaacccgttaaaacggtaaaaccgggttaaacgttccgggtacgggtaccgtaccggtaaccctaacggttaccgtttaccgttacgttacccgttaccgttaacccgtttccccgttaccccgtagttaaccgttacccgg

SEQ ID NO: 5419 - DNA, 920 bp, Homo sapiens
  misc_feature: GYAE6OF01B770Q.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgccaccctctccgtgtgcggccagtcaggagtcggttaggaccgtaacttcgcctggtatcgagcgaggacggtccctggccgaggaccctcccagtacccttcccctactacgtttccgtttcggggaccgtttaccccgttttaaaccgggaccggggtaccctaagggttaccgggaaaaccttcccccggaaggtccccggtaggggttaccaacgggtccgggtacgtacgggtttcgggggtccgttaggggggttacccttttccgggtttaccctaaccggtttcccttaccaaacccgttaaacttacccgtaaaaccgttaaaccccggttgaaacccgttaaacttaccgttaaacgggttaaccggtttaacccgttttacggttaaccgtttaaacgtttttttcgttttaccgtttacggttacgtaccggtaccggttacgttaaccggtttagggtaacgttaccggttacgggttaccccgttttaccggtaacccgggttttccggggaacccggggtaaaccggggtaacccggttaacggggtacccgggtaacccgttaaaccggtaaaaccggtacgggttaccggttaccgggtccggtaccggtacccgtacccggtaccgtttcccggttacctttacccgttacccttacccgtttaccccgttccccgtccgttaacggttacccg

SEQ ID NO: 5420 - DNA, 748 bp, Homo sapiens
  misc_feature: GYAE6OF01DBKFM.8.28.C06.1.454.CMB.1.raw
  modified_base (195)..(195): a, c, t, g, unknown or other
  misc_feature (195)..(195): n is a, c, g, or t
  modified_base (258)..(258): a, c, t, g, unknown or other
  misc_feature (258)..(258): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctccagagatcattggagaagtggtgatgacacagtctccggtcaccctgtcttgtttttccgnggggagagacgccaccctctcctgtgcggccagtcagagcgttaggacaacttagcctggtancagcgagacggcctcggccaggcctaccacgtactcctctattcgtttcggccgtaccgtttaaacggacgggtacctaaggttacgggaacctaccccgaacggtaccgtacgggttacgaacgggtccggtacgtacgggttcggggttaccgttacgggggtaaccttttcccggtttacctaaccgttcccttaaccgaccctaaagtaacctaaaacgtttaaacccctaggtaacctaaacgttccgtacggtaaaccggttaacttttacgggaaccttttaaggtttttaacttttccgtaacggttccgaacgttcgtaacgttacgttaacggaacgtaccgttcgggttaccgtttactacggttcgggaacccgggtaggaacccgtagggtacgtacctaacgaaaccgtagtggtcgcgtaccgacaaccctagtccgttgtacccttactaacgttcccttacccgctaggtccg

SEQ ID NO: 5421 - DNA, 844 bp, Homo sapiens
  misc_feature: GYAE6OF01BQJTW.8.28.C06.1.454.CMB.1.raw
  modified_base (130)..(130): a, c, t, g, unknown or other
  misc_feature (130)..(130): n is a, c, g, or t
  modified_base (139)..(139): a, c, t, g, unknown or other
  misc_feature (139)..(139): n is a, c, g, or t
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
tcagctcgcgtgtccacgaccggtgctcgatttagagctcacgtattggggtttggggaggaactgctcagttaggacccagacggaaccatggaagccccagcgcagcttctcttcctcctgctactcnggctccagngatcattggagagtggtgatgacacagtctccggtcaccgttgtcttgttttccgngggganagacgcctacctctccgtgtggccggactaggtcaggtacgtcggttaacggacgtaacttgccttagtactcgacgtanacggacggtcctggcctaaggcctacccgaagtcctacctacgtaacttccgtttacgggccgttaccgtttaaacggcgggtacccaaggtttaccggaaccttaccccgaggtacccgtaacggttcgaaacggtccggacgtaacgggttcggggttaccgtaggggaccgttttaccgtacgaaccctttccgaaccttaacccgtaacgttacctaaaaccgtttaacccgcgtaacccgttaagttacccttaccggtaaccgttaccgttttacgttaacggtttaacgtttttaccgtttacgtaccggttactaaccggttacgttaaccgttcgtaaggtaacttaccgggttacgttacccgttagttacccgggtttaccgggaccgggttaacgggtaaccggttaacgggtaccgggtacccgttaaacggtaaaacggtccgttaacgggtaggttacccgtaacggtacccgttaacgtaccgttcttaacccgggtttccttaacggtaccctttacccggttacccgtccgtacgtttaacccgg

SEQ ID NO: 5422 - DNA, 898 bp, Homo sapiens
  misc_feature: GYAE6OF01B1QMK.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgnggggacagacgcccacctctcctgtcggccgcagtcgagagtcgttaacggaccgtaacttacggccgtaggtactacgaggacgacggacggtcccgtcgggacccaggccctacccgacgtaccttcccgtactacgtttcggtttcgggacccgttacccgtttaaccggacgggtaccgtaaggtaccggaacctccccggacggtaccgttaggtccgaacgggtccggaggtacgggttcggggttaccgtcggggttaccttttaccgggtaccctaccttccgtaaccgaacctaacttaaccgaaaccgttaacccgtggtaaccttaacgttccgtaccggttaaaccgttaccgttttacgtacttttaacggttttacctttcgttacgtaaccggttagtaaccgttacggtttacgtaaccggttaaaccgtcccgggtttaccgggtttaccccggtttacgttaacccgggggttttaccgggggaaacggggtttacccggggaaaccggtttaaccggggttaccccgggtaaaccttaaaaccgggaaaaccccgggttcggtaccggttacggtcccggttacccggtaacctaaccccgttttacgttccggttaacccttttccgttacccttaccccgttttaccccgttaccccgtaccgttaccgggtttaacccgg

SEQ ID NO: 5423 - DNA, 822 bp, Homo sapiens
  misc_feature: GYAE6OF01AEGZJ.8.28.C06.1.454.CMB.1.raw
  modified_base (167)..(167): a, c, t, g, unknown or other
  misc_feature (167)..(167): n is a, c, g, or t
  modified_base (196)..(196): a, c, t, g, unknown or other
  misc_feature (196)..(196): n is a, c, g, or t
  modified_base (705)..(705): a, c, t, g, unknown or other
  misc_feature (705)..(705): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacanagtctccggtcaccctgtctgttttccgngggagagacgccacctcgtcctgtcgccggctagtcgagacgtcggttaacgacgtaacgttcgccgtagtagtacagacaggacggtccgtaggccacggcctacccgagtaacctccgtactattccgtttgggaccctaccgtttaacgacgggtactacggtaacggacctcccgacgtacccgtaggttaccgaggtaccggcggtaaggttcgggtacggtaggttacccgtttcgttacctaccgttatacccgtaactactaacctaaacgtaccgttcgtaaccgtaacttcgtacggttaccgttagtttaccgtaatttacggtttttacttaccgttacgtaaccgttacggtactaacggtttaccgtaaacgggtaacgttaccggttaccgggttacccgttttaaccggttaacccgggtttaccggggtacgggtaacccgggttaaacggttacggggaaccggtttaaacccaaacgggttaaaacccgngggttttacccggaacgggttcccgttaaccggaaccgtttaacccggttcgttaccgggttcctttaaccggttccctaacccgtttaccccgtccgtaacccttcggttaaccgg

SEQ ID NO: 5424 - DNA, 769 bp, Homo sapiens
  misc_feature: GYAE6OF01BKXZ7.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgtggccagtcagagcgttaggacgtaacttagccttggtatcagcgaggacggccctggccgaggcctcccgaagtacctcccctctacttcgtttcggccgtaccgttttaaaccgcggggtaccaggttacgggaaccttccccgaacggtcccgtaagggtttccaacgggtcccgggtacgtaacgggttcgggggttaccgttacggggggttaccttttccggttaccgtaacccttccttaacccgaacctaacttaacgtaaaaccttaaccctaggtacctaacttccgttacggtaaccggttacttttacggtactttaaggtttttactttacgttcgtactacgtaccgttacgttcgtaaggtaaacgttccggtcgggttacgttccgttaccggtttacgggacgggtaacgggtaaccgtaggtaccgggtacctaacggtaaaccgaacgttggtaccggtactcggtacccacgtcgttcgttacggttcccttacgtaccttcccgttacccgtcgtaccgttacccgg

SEQ ID NO: 5425 - DNA, 695 bp, Homo sapiens
  misc_feature: GYAE6OF01CF4AO.8.28.C06.1.454.CMB.1.raw
  modified_base (324)..(324): a, c, t, g, unknown or other
  misc_feature (324)..(324): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgtttttcctggggagagacgccacctctcctgtgcggccagtcagagcgttaggactaacttagcctggtatcagcaggacggcctggccaaggcctcccagacctccgtcattcgtttcggcctacctttaaaccgngggtccaaggtcggaaacctcccgaacgccgtaaggttccaaggtccggacgtaggtcggggtacgtcggggttacctttcgggttaccacttccctacgaaccctaagttaccgtaaaaccgttaaccctacggacctaaagttccgtaacgtaccggtaacttttacggattaacggttttaacttcgttagtaccagtccgtagtcgtaggaacggtacgttccggttccgttacgtacggttaccgggcgggtaacgggaccgtaacgggtcggtaccgtaaccgaaaacggtcgtaggtcggtacgtaccgactacctacgtcttacggtcttaccgtacttcccgtcccgtacctacgttaccgg

SEQ ID NO: 5426 - DNA, 780 bp, Homo sapiens
  misc_feature: GYAE6OF01A32J4.8.28.C06.1.454.CMB.1.raw
  modified_base (223)..(223): a, c, t, g, unknown or other
  misc_feature (223)..(223): n is a, c, g, or t
  modified_base (593)..(593): a, c, t, g, unknown or other
  misc_feature (593)..(593): n is a, c, g, or t
tcagctcgcgtgtccacgaccggtgctcgatttagagctcacgtattgggtttgggggaggaactgctcagttaggacccagacggaaccatggaacgccccagcgcagcttctcttcctcctgctactctggcctccagagatcagttggagaagtggtcgatacgacactacgtctccggtacctaccttgttcctttcggtttttccgaggggagagacncccacctctccgtgtcgcgaccagtcgaagacgtcgttaaggaccttaactcgccgttagtacacgacggacgaacgggcgcccggtggacccgaaggtccctaccggactaccctccttacgtactttccgggttaccggaccgttaaccgtttaaacggacgggggtacccttaggaacggtaacctccccgaagtacccggtacgtacgacgggtccggtacgtaacgggttcgggtacgttacggggtccttttacggtaacctccttaccgaacaaccttactaaactaactactacggtacctaacgttacgtacgtaccgtttacgttacgtaacgttttaacgttttcttacgtacgttacnggttacacgttacgagttaccgacggttcgtaccgtttccgacggttccggggaggtaacccggtaaggtacggtacggtaaacctacgtaaaacggttcgacggtttacggacctacgaaccttacggaactttcgtaaccgtttcgttaaccttccgttacccgttacccctaggttactacggg

SEQ ID NO: 5427 - DNA, 734 bp, Homo sapiens
  misc_feature: GYAE6OF01AGRD8.8.28.C06.1.454.CMB.1.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (248)..(249): a, c, t, g, unknown or other
  misc_feature (248)..(249): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccgtcaccctgtctgttttccgnggganacgacnccaccctctcctgtgccggcagtcagagtcgtagacgatgctgnnagcagcgctggccagccnccagactccnctactcgttgcctactttaacgcgggtcctaggtacgaactcccgagccgtaggttcgacggcggctaggtgggtcgtcggggtctttccgtcaccttctacctacctagtaacctaataaccctgtaacctacttcgtacgtaaccgttacgtttcgtactttaaggttttacgtttctacgttacgacgttacgtacgttacggtaagtaacggtccggttaccgttacccggtttaccgtttaaccgggtttaccgggaccggggttaaccgggtaaacccgggtaaacggggtttaccggtaacccgttaacccggtaaaaccggttaccgggtttacgggtacgggtacccgttaccggtaacccctaacccggttccgtttacccgttccggttttacccttacggttaccctttacccccggttaccccgtcccgttaaccttacccggg

SEQ ID NO: 5428 - DNA, 811 bp, Homo sapiens
  misc_feature: GYAE6OF01BI4L4.8.28.C06.1.454.CMB.1.raw
  modified_base (199)..(199): a, c, t, g, unknown or other
  misc_feature (199)..(199): n is a, c, g, or t
  modified_base (748)..(748): a, c, t, g, unknown or other
  misc_feature (748)..(748): n is a, c, g, or t
  modified_base (764)..(764): a, c, t, g, unknown or other
  misc_feature (764)..(764): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtcctccggtcaccctgtcttgtttttccgngggggagagacgcccgacccttcctccgtaggtcgccggcctacgtcaggacgcggttaaggaccgtaacttaggcctagggtatacgagtacagggacggtccgtcggacccgagggtccctacccgagtacccttcctactagtttcgtttcggaccgttaccgtttaaaccggacggggacctacgggtacggtaaaccgtccccgacggtacccggttaaggttccggaaggccgggtaccggtagggttccggggtttacggtacggggtttaccctttccgggttacctaacccgttcccgttacaaaccccgtagttaaaccctaacgttaacccgtacggtaaccttaacgttaccgttacgtaaccgttaccttttacgggtacttaacggttttacttccgtaggttaccgtagtaccgtacgtacgtaaggtaccgttacggttccggttaccgttacgttaccgggttacgggaccgggtaacggtacggtaaccgggtacgtaccgtaaccgtaaacgtggtacgtaccgggtacnccggtactacccgttntaccggttcgtacccttctacccgttccctacccggacctgtacccg

SEQ ID NO: 5429 - DNA, 829 bp, Homo sapiens
  misc_feature: GYAE6OF01CLNUQ.8.28.C06.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (797)..(797): a, c, t, g, unknown or other
  misc_feature (797)..(797): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttcgtttttcgngggganagacgcccaccctctccgtgtcggccggccagtcaggtacgtcggttaacggacgtaaacttcggccgtggtaactcgagcaggacggcccgtggcccgaacgggtccttccccgaagtaacccttcccctctacgtttccgtttcgggacccgttaccccgttttaaaacggacccggggtcccgtaagggttaccgggtaaaccttcccccggtaccggtaccccggtagggtttacccgaacggggtcccgggacgggttaacgggtccggggggtttaaccgtcggggggttaacccttttaccggttccgtaccgttcccgttaaccgaaccctaaacgtttaaaccgtaaaacctttaccccgtaggaaccttaaccgtacgttaccgggtaaccccgtttaacgttttcgaccgttttaacgttttacgttttaccgttacgtaccgtacgtacgtaaccgtgtaacgtaacgtaccgttccgggtacctttcgttaccgggttccggtacggggtaaccggacggttaaccggtaggtacccctaacggtaaaacggtccgtaggtcgacgtcgactactcgttntcgttccttctacgtaccctcctctacgtccg

SEQ ID NO: 5430 - DNA, 764 bp, Homo sapiens
  misc_feature: GYAE6OF01DHWIR.8.28.C06.1.454.CMB.1.raw
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
  modified_base (290)..(290): a, c, t, g, unknown or other
  misc_feature (290)..(290): n is a, c, g, or t
  modified_base (705)..(705): a, c, t, g, unknown or other
  misc_feature (705)..(705): n is a, c, g, or t
tcagctcgcgtgtccacgaccggtgctcgatttagagctcacgtattgggtttggggaggaactgctcagttaggacccagacggaaccatggaacgccccagcgcagcttctccttcctcctgcctactctcggcctcccagagatcgagttggagaaggtggtagatgacacgtagtacctccggtcacccttgttcgtttcggtttttcggngggganacgacgccctaccgtctccgtgtcgccggaccgagtcaggagtaccgtaggaactacgtcgcgtagtancagcaaggcggccgtcggaccgacggtcctaccgacgtacctctctaccgtttcggtttaccgggcctttaacccggtttaacgggaccgggtcccgtaacgggtagtaaaccctccccggaaccggtcggttaccggtacgaccggccgggagtacgggttcgggttacgtcgggttaccttccgttaccgtacctcctaacctacccgtaactaacgtaaaccctaccgtacgactaacgttactacgttaacgttcgtttacgttacgtttactttcgtttacgtacgttacgtacgtacgtacttacggtaacgtacgtacggtccgttcgttacgtaaccgggttcgggacgggtacggtaaccggtagtaccggaacctacggaacgtacgtggcgttacgtaccggtnaccggttctacggtttcgttacttacccgtacccttccggtcccgttaacgtcgtaccg

SEQ ID NO: 5431 - DNA, 702 bp, Homo sapiens
  misc_feature: GYAE6OF01C40EZ.8.28.C06.1.454.CMB.1.raw
  modified_base (121)..(121): a, c, t, g, unknown or other
  misc_feature (121)..(121): n is a, c, g, or t
  modified_base (176)..(176): a, c, t, g, unknown or other
  misc_feature (176)..(176): n is a, c, g, or t
  modified_base (207)..(207): a, c, t, g, unknown or other
  misc_feature (207)..(207): n is a, c, g, or t
  modified_base (242)..(242): a, c, t, g, unknown or other
  misc_feature (242)..(242): n is a, c, g, or t
  modified_base (296)..(296): a, c, t, g, unknown or other
  misc_feature (296)..(296): n is a, c, g, or t
  modified_base (662)..(662): a, c, t, g, unknown or other
  misc_feature (662)..(662): n is a, c, g, or t
  modified_base (672)..(672): a, c, t, g, unknown or other
  misc_feature (672)..(672): n is a, c, g, or t
tcagctcgcgtgtccacgaccggtgctcgatttagagctcacgtattggggtttgggggaggaactgctcagttaggacccagacggaaccatggaacgccccagcgcagcttctcttccncctgctacgtctggcctccagagatcaattggaagaagtggtgatgacacagtcnccggtcacctgttcttgttttccgagggganagacgcctacctctccgtgcggcgtccagccaagnggtaccgtaggaacctaagttcgccgtaggtacaccgaagtcgaacggcggccncgggtacacggccctaccggaatcctccgtatacgttccggttacggcctaaaccgttacggacgggacctaggtaccgaacctccggatccggtaaggtcaacgggcgtacggtaacggtcgggtacgtacgggtactttcctaacgcctactacaactagttaaccaaatacccttaggaacctagtacctaggtaacccttagttaccgtaagtttacgtttacttaacgggtcttacgaaggtacgttaccgtagttaaccgaagtcggtacgtacgttaacgtcggttcgggaaacgtaggtaacccgaaggtaccgaagttaacccgaaagtgtccggttggacctacggacaacggttntaaccggttntaccgtctactccgtccgaactgtaaccgg

SEQ ID NO: 5432 - DNA, 700 bp, Homo sapiens
  misc_feature: GYAE6OF01D5LD5.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgngggganagagccaccctctcctgtgcggccagtcagngcgttaggacgaacttgcctggtatcagcagagcctggccaggcctacccgagacctcctctacttcgtttcgggcctacccttttaaaggcggggtcctaaggttgggaacctccccgaaggtcccgtagggtttccaggccggtacgtagggtcgggttactggggtaccttttccggtactaccgtccttacgaccgtattaccaaacgttacccagtactaacttcgtacgtaacgtcttttacggactttagtttacgtttctcgtactaggtcctagttcgtaggaacgttacgttcggtcccgtttacttaccgggtttcgggacggggtaacggaaccgtaaggggttaccgtacccgttaaacgaaaaccggtacgttcgggtacggtcgtcggtaaccctacgtaacttcggttacgttaccttccgtaaccttccccgtttcccgcttgtacccgg

SEQ ID NO: 5433 - DNA, 703 bp, Homo sapiens
  misc_feature: GYAE6OF01CUB0T.8.28.C06.1.454.CMB.1.raw
  modified_base (197)..(197): a, c, t, g, unknown or other
  misc_feature (197)..(197): n is a, c, g, or t
  modified_base (696)..(696): a, c, t, g, unknown or other
  misc_feature (696)..(696): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacgagtctccggtcaccctgtcttgtttttccgnggggagagacgcccctaccctcgtcctggtacggccggcctagtccgaggtacggacgttaagggacgtaaacttcgcgtaggtactcgagcgaaggtcggccgtcggccgtacggcctcccacgtacctctctatttcgttacggcgttaccgtttaacggcggaccgtagtacggaactccccgagtcccgtaaggtccgaacggcggacgtacgggtcggttcgtcggggtacttttccggtactaccgtcctaccgaccttaactaaccgtaaacttacccgtgtaacctaagtccgtacgtaacggtactttgtaccgtttagttttacttacgtcgtactacgtctagtacgtacgtaacgttcggtcgttacggttaccgttacggttcggggaccgggacggtaacggttacgggaacgtaccgtaacgaaacggtacgtggtcggtcacggtacctacgtaccttgttcctacttcaccttcctacccgntcgtacg

SEQ ID NO: 5434 - DNA, 743 bp, Homo sapiens
  misc_feature: GYAE6OF01AN5OI.8.28.C06.1.454.CMB.1.raw
  modified_base (442)..(442): a, c, t, g, unknown or other
  misc_feature (442)..(442): n is a, c, g, or t
tcagctcgcgtgtccacgaccggtgctcgatttagagctcacgtattgggtttgggggaggaactgctcagttaggacccagacggaaccactggaagcccagcgcagcttctcttctcctgctactctggctcccagagatcattggagaagtgtgatgacacagtctccggtcaccctgtcttgttttccgtggggatagacgccaccctctcctgtcgcggcagtcagagtcggtaggacgtaacttgccgttgtatacagccaggacggccgtaggccgaagggacctcccgagtaccgtcctcgtactttccgtttgggtcccaccgttttaaacgcgggcctaaggtcggaaccttccgacgcgtacggtcacgcgacgtacggtggtcgtggggtcgttcgtctacctcgtacaccttacgtacaacgttaaccncgtaaccacttacacgtaccgtaactttcgggtacctaggttttttaactcgtttacgtacgtacgtaccgtaacgtttccgtaacgtaacgtaacgttccggttaccggtttaccgttaaccgggttttacccgggtacggggttaaccggtaacccgggtacggttaccggtaccggaaccgtttaaaaccggattccgggttagtacccggttacggtaccctaccggtaaacctttcgtaacggttttccttacccggtactttacccgtttcccccgtaaccggttccttaaccgg

SEQ ID NO: 5435 - DNA, 994 bp, Homo sapiens
  misc_feature: GYAE6OF01BOZTJ.8.28.C06.1.454.CMB.1.raw
  modified_base (198)..(198): a, c, t, g, unknown or other
  misc_feature (198)..(198): n is a, c, g, or t
  modified_base (972)..(972): a, c, t, g, unknown or other
  misc_feature (972)..(972): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacccttgtcttgtttttccgnggggagagacgcccaccctctccgtgtcgcggccagtcaggacgtacggttacggacgtaaacttacgccgtaggtaactccgagaccaagggacggtcccgtacgggcccgacgggaccttccccggaacgacccttccctaccgtacgtttccgttttacggggccccgttaacccgttttaaacggaccggggggaccctaagggttacgggtaaaccttcccccggaaggaccccgttacggggtttaccgaacggggcccgggtaccggtaaggggttccggggggttccgtttaaggggggttaccctttttaccggtttacccgtaacccgtttaccctacccttaaacccctaaacgtttaacccgtaaaaacgttaaccccgttacggtaaacccgtaaacgtttacccggttaacgggtaaccccggttttaacccgtttttcggtaacgttttaaacggtttttttaacttttcccgtacggttaccgttaacggtaccgtaccggtttacgttaacggggtaaacgttcccggttaccgggttaccccgttttacccggtttacccggttttacggggggaccggggtaaccgggttaaacccgggttacgggttaaccccgggtaaccgtttaaacccggtaaaaaccggttaaccggggttcggtttaaacgggcccggttaaccgtaacccgtacccttacggtttccggttaacccgtttcccgtttaaacgtaccctttacccccggttttaccccnccggtaaaccgttttccccggg

SEQ ID NO: 5436 - DNA, 783 bp, Homo sapiens
  misc_feature: GYAE6OF01CN8SQ.8.28.C06.1.454.CMB.1.raw
  modified_base (201)..(201): a, c, t, g, unknown or other
  misc_feature (201)..(201): n is a, c, g, or t
  modified_base (772)..(772): a, c, t, g, unknown or other
  misc_feature (772)..(772): n is a, c, g, or t
tcagctcgcgtgtccacgaccggtgctcgatttagagctcacgtattggggtttgggggaggaactgctcagttaggacccagacggaaccatggaagccccagcgcagcttctcttcctctgctactctggcctccagagatcattggagaaggtggtgatgacacgagtcctaccggtcaccctgtcttggttttccgngggagcgacgccaccgtctcgtgcgccggtcagtacgagtaggtacggttaacggaacgttaacttacggtccgtaggtacgtacgacggacgaacggtacggcccggtacgggacccgaacgggtacccaccggtaaccgtacccttcctacgtactttcggtttaccggacctttacccgttaaacggcgggtacccaagggttaccggtaaccgtccccgaacggtaccgttaacgggcgaacccgggtggtaccggttaacggggtttcggggtccggtttacggttaacccgtttcgtacgtaacccgttcctacccgtaaactacctaaacgtaaaccttaccgagttactactaccggtagttaaccgttacgttcgttacgtttaagttttattccgtataccggtcggttaactacggtacgttaaggtaccggttacggttcgggtacccgttacgtaccgggttacgggaacggacggtacggtaacggtacgaccgttaacgaacgtacgttcgacgtcgtcgactactcttcgtcgttactccttactcccgttaccncctaaggttcg

SEQ ID NO: 5437 - DNA, 853 bp, Homo sapiens
  misc_feature: GYAE6OF01BIN0B.8.28.C06.1.454.CMB.1.raw
  modified_base (263)..(263): a, c, t, g, unknown or other
  misc_feature (263)..(263): n is a, c, g, or t
  modified_base (390)..(390): a, c, t, g, unknown or other
  misc_feature (390)..(390): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttccgtggggagagacgccaccctctcctggtgcggccagtcagagcgttaggacgtaacttagcctggtancagcaggacggcctggccaggcctacccagacctcctctattcgtttcgggcctaccgtttaaacggacgggtacccgaggtacggtaactccccgtaaggtaccccgtagggttcgagggtccggngtacgggtcggggtcttaggggtacctttcggttcaccgttccaccgtaaacctagttaccaaaacgttacccgttaggaacctaacgttaccgttaccgggtaaccgtttaaccgttttacggttaaccgtttaaggttttttaacttttaccgttacgttaccggtaacgtacccgttaaggttacgttaaccgggtaacgttaacccggtttcccgggtttacccggtttaacccggttacccgggtttttaacccgggggacccgggggttaaaccggggtaacccgggttaaacgggggtacccgggttaaccccggttaaacccggaaaaccgggttaaccgttacggggtaccgggtaccggtccggtaacctaacccgttaagttcccgtttacggtttacccgtttacccgttaacctttaccccgttccccgtacccgttaaccgttacccgg

SEQ ID NO: 5438 - DNA, 715 bp, Homo sapiens
  misc_feature: GYAE6OF01A002S.8.28.C06.1.454.CMB.1.raw
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
  modified_base (499)..(499): a, c, t, g, unknown or other
  misc_feature (499)..(499): n is a, c, g, or t
  modified_base (710)..(710): a, c, t, g, unknown or other
  misc_feature (710)..(710): n is a, c, g, or t
tcagctcgcgtgtccacgaccggtgctcgatttagagctcacgtattgggtttgggggaggaactgctcagttaggacccagacggaaccatggaacgccccagcgcagccttctcttcctcctgctactctggctcccagagatcattggagaagtggtgatgacacagtcctccggtcaccctgtcttgtttttccgngggganacgacgcctaccctctccgtgtcgcgacngtcgagagtcgtaaggactaacgttcgccgttaggtactcgagcaggacgtcccgtggacccaggccctaccgagtacctcctatacgttcgttcgggacccttacgtttaacgacggggtaccctaaggtacgggtaaccctccggaacggtccgtaacgggttcaacggtccggtacgtagggtttcggggtaccgtcggggtacctttccggtactaccgttaccctacgtacccgtaagtaacctaaacttaccccggtntaacctaacgtctacgtacgttaacgttcgtactttaggtttacttcgttacgtctaacgtactacgtacgtacggtaacgtaccgtcggtacgttccgtacggttccggaacgggtaccggtaaccgtaggtaaccgtacgtaacgaaacgtcgacggtcggacgtacgtacgactacgtcgtacttctctacgttccctaccgtccgtnaccgg

SEQ ID NO: 5439 - DNA, 645 bp, Homo sapiens
  misc_feature: GYAE6OF01AUOA3.8.28.C06.1.454.CMB.1.raw
  modified_base (452)..(452): a, c, t, g, unknown or other
  misc_feature (452)..(452): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagacgccaccctctcctgtgcggccagtcagagcgttaggacgtaacttagcctggtatcagcagaggcctggccaggcctcccagactcctcatctttggtgtcctttaacgacgggcctaggtcggaactcccagccgaggttacaggcggcgtaggtgggtcgtcgggtacttcgtctactctaccaccatacaataacctgactaatctagacgtactttgtactaagttttattcgtacgtcgtancgtacgttactacggaaagtccgttagggtcccgtttccgtaacgtttcgggaccgggtaacggggaccgtaaacggggtaccggacccgtaaacgaaaccggtaacgttcggtaggtaccgtacgtaccaaccgtagttccgttacgttacctttacctacgttaccccgttccccgtcctacgttacccgg

SEQ ID NO: 5440 - DNA, 750 bp, Homo sapiens
  misc_feature: GYAE6OF01BI3AO.8.28.C06.1.454.CMB.1.raw
  modified_base (199)..(199): a, c, t, g, unknown or other
  misc_feature (199)..(199): n is a, c, g, or t
  modified_base (560)..(560): a, c, t, g, unknown or other
  misc_feature (560)..(560): n is a, c, g, or t
  modified_base (567)..(567): a, c, t, g, unknown or other
  misc_feature (567)..(567): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcagttggagaagtggtgactgacacagtcctccggtcaccttgtcttgttttccgngggagacgacgccctaccctctccgtgtcgaccggtccagtacgaggacggtcggttaacggacgtaaacgtttcgccgttaggtaactccgaggaccgaaggcgggtcctacggccgaccggtcctacccgaacgttccctcctactacgtttcggtttacgggcccttaccgtttaacgaccgggtactaacggttacggtaaccctaccgacggtacccgtaggttaccgacggccggtacggacggtttgggtaaccgtcgggttaccttacggtccctaacgtcctaacgacctaactacgtaaacttccgtagaacttacgtaccgtagtaaccttacgtttagtacttagtttnttaccgngttacacgtacgtacgtactacgtaagtccgtacgggttcttaacgtccggttacgggcgtaaccggtaccgtaaggtccgtaacgaacgtaaacggtcgttgggtaccgtacgtacgtaccctagttccgttagttccgttacccttaccgtacgtccccctttccgaactcgttaaacggg

SEQ ID NO: 5441 - DNA, 854 bp, Homo sapiens
  misc_feature: GYAE6OF01ELSOD.8.28.C06.1.454.CMB.1.raw
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
tcagctcgcgtgtccacgaccggtgctcgatttagagctcacgtattgggtttgggggaggaactgctcagttaggacccagacggaaccatggaacgccccagcgcagcttctcttcctcctgctactctgcctccagagatcattggagaagtggtgatgacacagtccgtaccggtccaccctgttcttgtttttccgnggggganagacgcctaccctcgtccgtgtcgcggccagtcaggacgtacggttaaggaacgtaacttacgccgtaggtactcgagacgaaggacggccgtgggcccgacggcccttacccgagtacccttcctacgtactttccggtttaccgggacctttaaccgttaaaccggacggggtaccctaagggtaccggaaccttccccggaacggtccggtaaggttcgacggccggtacggtacgggttcgggttacggtcgggttaaccctttcgttacctacccgttaccgtaacccgaaccccttaattaacccgtaaaaccgtttaaccccgtagttaacccgtttaacgttacccggttaaccgggttaaccggtttaccgttttaacggttcgtttaaaacgttttttccgttcgttaaccggtagtaaccggttcgtaacgttacggtaacggtaacggttcggtaccgttccggtttaccgttaacgggttacggggtaccggggtaaaccgggtaacggtaacggtaccggttaacccgtaaccgtaaaccggtcgtcggtaccggtacgtaccgtacccgtacgtacgttccgttacgttaccttaccggtaccttaccccggtcccgtgtaccgtaacgg

SEQ ID NO: 5442 - DNA, 857 bp, Homo sapiens
  misc_feature: GYAE6OF01E4CP2.8.28.C06.1.454.CMB.1.raw
  modified_base (204)..(204): a, c, t, g, unknown or other
  misc_feature (204)..(204): n is a, c, g, or t
tcagctcgcgtgtccacgaccggtgctcgatttagagctcacgtattgggtttggggggaggaactgctcagttaggacccagacggaaccatggaagcccccagcgcagcttctcttcctcctgctactctggcctcccagagatctagttggagaaggtggtgatgacacagtctccggtcacctgttcttcgtttttccgngggggagacggacgccctaccccgtcttccgtggtcgccggcctagtcaggacgtcggttaacggacgtaacttacggccttggtactacgagccgaaggacggtcccgtcgggtcccacgggtccctaccccgtaggacccttcccttactacctttccggttttacgggcccttacccggttttaaccgacggggaccctaggtaccggactccccgagtcccgtaaggttcgacggtcggacgtacggttcgggtacggttcgggtacctttccggtaccaccgttcctacgtaaacccgtacttaaccgtaaaccttacccgtacgtaccgtaacttccggtacgtaaccggtttaactttcggtaaccttttaagttttaaccgttcttttacgccgttacgtaccgtaacgttaccgtaacggtaaccggtaccggttccggggtaaccctttccggtaaccgggttcccgggaaccgggtaaacgggtaccggtaaaccggggttaccgtacccgttaaccgaaaccgggtaccgttagggtacccggtccgtaaccgtaccccgtaaccgttaaccgttccgttacccgttacccttaccgtaccccgtttacccccggttccccgtaaccgttaacggttcccg

SEQ ID NO: 5443 - DNA, 887 bp, Homo sapiens
  misc_feature: GYAE6OF01D8D4M.8.28.C06.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccgtcaccctgtcttgttttcgnggganagcgccaccctctccgtgtcgccggccagtcgagacgtacggttaacggacgtaacgttacgtccgtaggtactcgagcgaaggacggtccgtcggacccgacggccctacccgaagaccttccctacttacgtttccggttttcgggacccgttaacccgttttaaacggaccgggggtacctaagggttacgggtaaacccttacccccggaacgtacccggtaacgggtttaccgaacgggtacccgggtacggtacgggtttcggggttccggttacgggggttaacccttttccggtttacccgtacctttcccgtaaccctaaccctaacgttaacccttaaaaccttaaacccggtgtaaccctaacgttacggttaaccggtaaccggttacttttacggtaacgtttacgtttttaactttcgtacgttctaaggtccgttaagttacgttagggtaacttaccggttccggttacccggttttaccgttaccgggtttcggggaaccggggtaacgggtaaacccgggtaaacggggttaccgggtaacccgtaaacggtaaaaccggttaacgtcggggttaccgaccgttaccgtaacccgaccgtttacgttccgtttacgtttacccgtttacccgtaacctttcccccgttaccctaccgttacgttaccgg

SEQ ID NO: 5444 - DNA, 737 bp, Homo sapiens
  misc_feature: GYAE6OF01CV5E8.8.28.C06.1.454.CMB.1.raw
  modified_base (423)..(423): a, c, t, g, unknown or other
  misc_feature (423)..(423): n is a, c, g, or t
  modified_base (705)..(705): a, c, t, g, unknown or other
  misc_feature (705)..(705): n is a, c, g, or t
tcagctcgcgtgtccacgaccggtgctcgatttagagctcacgtattggggtttgggggaggaactgctcagttaggacccagacggaaccatggaagccccagctcagcttctccttcctcctgctactctggcctccctagtttcaagactaacccgaccgggagtaagtagtttgtacggttacgaacactacggttcctaccgaacggtccctaccccgtttgttccttttcggtaccgtaccggaaagggggtaaaacaccggccctaaccccttcgtccgtgaccggacgggtaccagtacgaagtaagtcgggttcggccgtaccgttcggaacgtcgtacggtaaccaacaaaccgaacgcggaccacggaccgtcccgaaccggtccccctagtaactacgttaggtcggtacnccgtaacgtaccaaacggccgggacctaacgcggacctaccgaccgtacggaccgtaggtccgtaggtcgacggtaggttggagtacgggactacggtactacgtacctcgaccatactcacgtcgacgtcgtaacgcgtacgtagtacggtacttgtacgttattacgttatacgtacgatactagtcccgaggtacgtccgggtccgtacggtcctaccggttaccgacggtacggacggtaggtcgacgtaacgtaacgaacgtgcggtacgtaccgtnaccgttctacttacgacttcgacgtttacccg

SEQ ID NO: 5445 - DNA, 715 bp, Homo sapiens
  misc_feature: GYAE6OF01CM9E1.8.28.C06.1.454.CMB.1.raw
  modified_base (167)..(167): a, c, t, g, unknown or other
  misc_feature (167)..(167): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (537)..(537): a, c, t, g, unknown or other
  misc_feature (537)..(537): n is a, c, g, or t
  modified_base (666)..(666): a, c, t, g, unknown or other
  misc_feature (666)..(666): n is a, c, g, or t
  modified_base (699)..(699): a, c, t, g, unknown or other
  misc_feature (699)..(699): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgcctactctggcctccagagatcattggagaagtggtgatgacacngtcctccggtcacctgtcttggttttccgngggganagacgcccaccctctccgtggtcgccggactagtacgaggcgtacggttaaggaccgtaaccttagccgtaggtactcgagtacaggacggtccgtacggccaacggccctaccgacgtacctccgtactcgttcgtttcggccgttaacccgttaacggaccggggacctaaggtacggtaacctcccgaacggtcccgtacggtcgaacggtcggtacgtcgggtcgggttacgtcgggtactttccggactctaccgttacaccgttataaccgtaactacccgtagactaacgtcgtacgtacttacgtttgactttagtttcttacgtntacgagtcgtaacgtgaacgtacgtcttccggtacgtttaccgtacggtccggacgggtacggaaccgttaacgggtcccgaaccgtaacgtacgtacggtcggtacggtacgtaccggtactaccgtnttacccgttcgttacgtacctccgtttaccccnccgtactcggttaccg

SEQ ID NO: 5446 - DNA, 828 bp, Homo sapiens
  misc_feature: GYAE6OF01DSZY8.8.28.C06.1.454.CMB.1.raw
  modified_base (287)..(287): a, c, t, g, unknown or other
  misc_feature (287)..(287): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcagttggagaagtggtgatgacacagttcctccggtcacccgttgttctttggttttttccgaggggataggaccgccctacccttctcctggtcgccggaccagtcgagagtcggttaaggaactaacttagccgtggtacncgagcaggacggcgtacggaccgacggcctaccgaacgtccttacctcttacgtttccggttttcgggacccgtttaccgttttaaacggacgggtacccgtaaggtacggtaaaacctccccgagtacccgttacggttacgacggacggtacgtgggtcgggttcgttacgggtacctttccgtctaccgtacttccaaacctcgtaacctaaactacctgaaccttagttcgtacgtacgttacgtttacgttacgttttacttttagttccgttagttaccgtaagttcgtaaacgttcggttaacgaaacggttccggttaccgggttaacccgtttcgtttaccgggttaccggggaaaccggggtaaccgggttaaaccggtaacgggttaacccggtaaaccgtaaaccgggttaaacgtaccggtgggttaaccggtaccgtccggtaaccttacccgttacgtttcccgttacggtttacctttacccgttacccgtttccccgtaccccgtaccgttcgttaacccgggg

SEQ ID NO: 5447 - DNA, 614 bp, Homo sapiens
  misc_feature: GYAE6OF01ATNLT.8.28.C06.1.454.CMB.1.raw
  modified_base (574)..(574): a, c, t, g, unknown or other
  misc_feature (574)..(574): n is a, c, g, or t
  modified_base (607)..(607): a, c, t, g, unknown or other
  misc_feature (607)..(607): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggcaggtcagagcgtagacgacttagctggtatcagcagaggctggcaggctcccgagacctcctacatccgtttggccgtaccctttaagacggggtccaaggtcggaaactccccgaagtccgaaggttcaggcggcgtaaggtcgggtcgtagggtaccttcgtacacgtctcccaactataccaaataaaccgtgactaacgtctacgtacgtactttgacttagtttattcctgtactgtactagtcctagtaacgtacgtccggtacgtttcgtacgtttcgggaccgggtaacgggacctaagggtcgtacctacgaaaccgacgtgtacggacgtcgtacaccgtntacgtcgttacctactacgttaccctcccggtntacgtcg

SEQ ID NO: 5448 - DNA, 953 bp, Homo sapiens
  misc_feature: GYAE6OF01BUAU3.8.28.C06.1.454.CMB.1.raw
  modified_base (130)..(130): a, c, t, g, unknown or other
  misc_feature (130)..(130): n is a, c, g, or t
  modified_base (141)..(141): a, c, t, g, unknown or other
  misc_feature (141)..(141): n is a, c, g, or t
  modified_base (944)..(944): a, c, t, g, unknown or other
  misc_feature (944)..(944): n is a, c, g, or t
tcagctcgcgtgtccacgaccggtgctcgatttagagctcacgtattgggtttgggggaggaactgctcagttaggacccagacggaaccatggaacgcccagcgcagcttctcttcctcctgctactcnggcctccaganatcagttgggaagaagtggtagatacggacaactacggtccgtcccggtacctacccgttgttccgtttggtttttcccggagggggaagacgggtacgaccccacccttcctaccgtggtcggaccgggccaggtacaaggtaagggtaccggtttaagggaaccgtaaaccgttcggtaccgttaggtaactcaacggcgaaggacgggtcccaggaccgagggccctaccgacgtaccctcctctaacgttcggtttacggccgttaacccgtttaacgacgggtacctaaggtaaccggtaacctccccggaaggtccccgtaagggttaccacgggacgggtccgtaaggggtttacggggtaccggtttaacgggggttaccgttttccggttaaccggtaaccgttacccgtaaacccgtaaacccgttaaacgtaaacctttaaaaacccggttaaaacccttcgggaaaccttaaaaccggttccgtaaacggggttaaaccctttaacggttttagttaacccggttttaaacgttttttaacgttttaccgtaacggtaccgtacggtaacgttaacgggttactaaacgggtaaacgtaacggttccgggttaacccttaacgggtttaccgggtttaccggggaacggggaaacgggtaacccggttaacggggtaaccgtaaccgttaaaccggaaacggtaacgtcggggttaacgacccgttagaacccgtacgtccttacgttacgttaccctttaacggcccttaacccctttcccgaccggttntaaaccggg

SEQ ID NO: 5449 - DNA, 695 bp, Homo sapiens
  misc_feature: GYAE6OF01C86QB.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (267)..(267): a, c, t, g, unknown or other
  misc_feature (267)..(267): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
  modified_base (496)..(496): a, c, t, g, unknown or other
  misc_feature (496)..(496): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgactgacacagtctccggtcaccctgtctgtttttccngggganacgacgcctaccctctcctgtcgcggccagtcagagtcgttaggactaacttcgccgtggtactnagcaggacggtctggaccaggcctacccagacctcctcattccgttcggacctaccgtttaacgcgggtacctaaggtacggtaacctaccccgaggtacccgtaggttaccaaggtccggaccgtaggtcgggtcgttaggggcctttaaacggtcactctaccncaatctaaataaccgtnacgtaactctagtaccttagttcgtacgttacgttttatttccgtntacctaaggtacgtacgtactaaggtaacgacgttacggtccgttacctacggtttaccggggacggtaacgggaccgtaacgggtacggtaccacgtaaaaaccggtacgtacggttcggacgttacggaacccttaacgtcgttaccgttacgtttcttaccttacccgttcccgttaccctcccgtaaattcccgg

SEQ ID NO: 5450 - DNA, 855 bp, Homo sapiens
  misc_feature: GYAE6OF01ELZMB.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttcgnggggagagacgcctaccctctccgtggtgccggcagtacagagtcggttaaggactaacgttacgccgtggtatcagtcgacggacggtcctggacccgtacggacctacccgaacggtacccttcccgtaccgtacgtttccgttttcgggaccggttacccgttttaaaccgggcgggtaccgtaaggttacgggaaacctccccggaacggtcccggtaagggtttccgaggccgggtacgtaacggggttcggggtacgtacggggttaccttccggtttaaccaccgttcgtaccaaccgtacgttaaccaacgttaacccgtacgaacttaacgttccgttaacgtaacgttacgttttacgttacgtttacggtttttaacttcgttacggttccgaacgtcggtacgttaacgtacggtaacggtacccggttacggttacccgtttaaccggttacgggtttcccggggtaacgggggtaaaccgggtaaccggttaaacggggtaccggttaacccgtaaaccggtaaaaccgggttacgtacgggttcggttaaccgtacggtaccccgttaagttaccgtttccgttacggtttcccgtttaaccgttacccgttaccccgttttaccccgccgttacggtaaccggg

SEQ ID NO: 5451 - DNA, 654 bp, Homo sapiens
  misc_feature: GYAE6OF01AXC1X.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgccaccctctcctgtgcggccagtcagagcgttaggacgaacttagccgtggtatcagcaggacggcctgggccagggtcctcccgagaccttcctctacttccgttttcggccgtacctttaaacggacggggccctaaggtcggaaacttccccgagtccgtaggttccaggccggcgtaggtcggggtctggggtacctttcgtcgtactcctcaccatacaaacgtacctgactactctacgacgtacgtttcgcttaacgttttacttacttcgtacacgtactacgtcgtaggaacgtacgtcgggtccgtttccgtaccgtttcggggacggtacgggaaccgtacgggttacggacccgtaacgaaacgtacgtagtacggtcgtacgtaccacgtcttaccgtcgttcttacctcttacccgtcccggtctacgtacg

SEQ ID NO: 5452 - DNA, 911 bp, Homo sapiens
  misc_feature: GYAE6OF01DEL3J.8.28.C06.1.454.CMB.1.raw
  modified_base (208)..(208): a, c, t, g, unknown or other
  misc_feature (208)..(208): n is a, c, g, or t
  modified_base (896)..(896): a, c, t, g, unknown or other
  misc_feature (896)..(896): n is a, c, g, or t
tcagctcgcgtgtccacgaccggtgctcgatttagagctcacgtattggggtttgggggaggaactgctcagttaggaccagacggaaccatggaagccccagcgcagcttctcttcctcctgctactctggctccagacgatcattgggagtaagtggtgatagacacgagtcctccggtactaccctggttccttggtttttccgnggggagacgacgccctaccctctccgtaggtcgccggacctacggttacgaacgacggtaccgggtttaacgggaaccgttaaaccgtttacggtccggttagggttacctaccgaagaccgtaacggggaccgggtccgtaccgggaccgtaacgggtaccctacccggactaaccctcctactcgtttccggtttacgggaccgttaccgtttaaacgcggggtacgtacgggtacgaaccgttaccccgaggtacccgttacggttacgacggtacggtgtaacgggtttccgggtacgttcggggttaacccttttcgtacggtaccttaccgtaaccggaacctacttaaactaaaccgttaaccgtttcgaaacccgttaacgttaccgtacggttaaccgtttacggtttcgtacgttttaaccgttttactttacgttacgttactacggtaccgttaaggttacgtaacgggttaacgtccgggtttaccggtttacccggtttaacgttacccgggtttaaccggggaccgggggtttaaccgggtaaccgggtaacgggttaacccggtaccgttaaaccggtaaacccggttacggtacgggtaccgtcggttaacgacccgttaacgttcggtaccgttacgtaccctttaccggtccctttacggttcccccgngttacccggtaaccg

SEQ ID NO: 5453 - DNA, 803 bp, Homo sapiens
  misc_feature: GYAE6OF01DSE9V.8.28.C06.1.454.CMB.1.raw
  modified_base (130)..(130): a, c, t, g, unknown or other
  misc_feature (130)..(130): n is a, c, g, or t
  modified_base (167)..(167): a, c, t, g, unknown or other
  misc_feature (167)..(167): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (449)..(449): a, c, t, g, unknown or other
  misc_feature (449)..(449): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactcnggctccagagatcattggagaagtggtgatgacaacngtctccgtcacctgtcttgttttcgngggangacnccaccctctccgtgtgccggacagtcgagacgtacgttaggacgtaacttagcctaggtacncgagcaggtacggcctcggaccgtacggacctccgaacgtacttccgtacttacgttcggttttcggaccgttaaccgtttaacggacggtacgaacggttacggaaccgtacccgacggaccgtacggttaccgacgggccggtcgtaggtacgggtcgtacggggttacctttccggttaccnccttactaacccgactaacctaactaaaccttaacctgaacctaacgttactaccgtaacgttcgtttacgtacgtttagttttaactttgtacggttacacggtaccgtagttaccgtaaggtaacgtaccggttccggtccgtttaaccggtaccgggtttccgggaaccggggggtacggttaaccggtaaaggggttaccgtaaacccgttaaaccggtaaaacgttaccgggtggttaccgggtaccgttaaccgaacccgtttacccggtaacgtttcccggttaccgttttaacccggttccttaacccggttttcccccgtaccccggtccgttagtaaacccggg

SEQ ID NO: 5454 - DNA, 670 bp, Homo sapiens
  misc_feature: GYAE6OF01CE2SF.8.28.C06.1.454.CMB.1.raw
  modified_base (195)..(195): a, c, t, g, unknown or other
  misc_feature (195)..(195): n is a, c, g, or t
  modified_base (237)..(237): a, c, t, g, unknown or other
  misc_feature (237)..(237): n is a, c, g, or t
  modified_base (301)..(301): a, c, t, g, unknown or other
  misc_feature (301)..(301): n is a, c, g, or t
  modified_base (433)..(433): a, c, t, g, unknown or other
  misc_feature (433)..(433): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctccagagatcattggagaagtggtgatgacacagtctccggtcaccctgtcttgtttttccgnggggagagacgccctaccctctcctggtcgcggccagtcagngtcgttaggacgtaatcgctggtatcagcaggacggctggccaggtcctcccgagacctccgtnactttcgtttcggccgttacctttaaacgcgggtacctaggtacggaactccccgagccgtaaggttcaggcggcgtaggtcgggtctcggggtacttcggtcaccgtctacacctataccgtaaactaccngtacctatcgtacgtaacgtactttcgtacttagttttacttcgtatcgtacgtacgtacgttacgtagtaaacgttccggtacgtcccgtttaccgtacgttcggggacgggtaacgggtaaccgtacgggttcgaaccctaacggaaaccgtacggtggtacggccgtacggaccaacgtcgttacgttccgttacgttacttacccggttccctacccggtataccgttaccgg

SEQ ID NO: 5455 - DNA, 823 bp, Homo sapiens
  misc_feature: GYAE6OF01B2JA6.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
  modified_base (777)..(777): a, c, t, g, unknown or other
  misc_feature (777)..(777): n is a, c, g, or t
tcagctcgcgtgtccacgaccggtgctcgatttagagctcacgtattgggtttgggggaggaactgctcagttaggacccagacggaaccatggaacgccccagcgcagcttctcttcctcctgctactctggctccagagatcattggagaagtggtgatgacacagtctccggtcaccctgtcttgttttcngggganagacgccacctctcctgtcgcgccagtcagngcgtaggactactgcctggtancgagcgagacggtccgtggaccacgggtcctacccgacgaccttccctacgtacgtttccgtttcgggcccgttacccgttttaaacggccggggtacctaggtacggtaaaccttccccgaaggcccgttaacgggttcgaacgggtccgggtacgttacgggtcgggggttccgttacgggggttacccttttccgggttaccctaccgttccctaaccctaacccgtaaacttaaccctaaaaaccgtttaaccccgtaggtaaccctaaccgtttaccggtaacggttaacccggtttacgtttttacggtacccgttttaagttttttaccgtttcgttaacggttccgaacgttacggttaacgttacgtaacgggtaacgttaccggttccgggttacccgtttaccgtttaccgggtttaccggggaccggggttaacgggaacccggtaacgggtacccggtaaacgtaaccgtaaaaccgggtcgttacggtccgtacgtccgaccctaccgtnttccgttcgttaccttctaccgttcccctccgtacccgtgttacgg

SEQ ID NO: 5456 - DNA, 873 bp, Homo sapiens
  misc_feature: GYAE6OF01A61NR.8.28.C06.1.454.CMB.1.raw
tcagctcgcgtgtccacgaccggtgctcgatttagagctcacgtattggggtttgggggaggaactgctcagttaggacccagacggaaccatggaagccccagcgcagcttctcttcctcctgctactctggcctcccagagatcagttggagaagtggtgatgacacgagtccgtccggtccacccttgttcgtttcgtttttccgtgggggagtacgacgccctacccgttctcccgttggtcggccggaccgacggttcaaggacgtacggttaacggaaccgtaacgttacgtccgttaggtactccgaagaccgaaggtcggtaccctcgggaccgtacgggtccctaccccgaagcccgtttcctaccgtacggtttccgtttacggggaaccgtttacccgtttaacggaccggggtactaacgggtaacggtaaccctcccgaacggtaccgttacgggttacgaccggtccgggtacggtacggttcggggttaccgtaggggttaccctttaccggttaccgtaccgtaccttacccgaaaccctagtaacctaaaccgttccgtacgtactaacgttacgtacggtaacccgtttagtttacggttacctttaaggttttacttcgttaggtacctaacggtcgtagttaccgtaagtacgttacgtccggttacttacgttacgggttcccgggtagggtaaccgggtaacccgttagggtaaccgtaacccttaacggtaaacggtacccggttaggtacccggttacggtaacccgttaacccacggttacctttacccggttcgtttaccctttacggttccccttaaccggtttccccgtaacgttcgtaacccgg

SEQ ID NO: 5457 - DNA, 821 bp, Homo sapiens
  misc_feature: GYAE6OF01B5JFB.8.28.C06.1.454.CMB.1.raw
  modified_base (324)..(324): a, c, t, g, unknown or other
  misc_feature (324)..(324): n is a, c, g, or t
tcagctcgcgtgtccacgaccggtgctcgatttagagctcacgtattggggtttgggggaggaactgctcagttaggacccagacggaaccatggaacgcccagcgcagcttctcttcctcctgctactctggcctaccgagagatcagttgggaagaaggtggtgatacggacactacgttccgtccggtctacccttgttcgtttcggtttttccggagggggacgacggcgcccctaccttccgtccgtggtcggacggtaccgtagtcgaaggtacggtacgggtttaacggaacgttaacgttacggccgttaggtacncgaggacgaacggcggccgtcgggacctacgggtcctacccgaaggttcctcctcgtctttcggtttacggaccttacgttaacggacggtacctaagggacgtacctaccgaggtcccgttagggtacgacgggtcggtcgttacgggttcgggtcgttagggttacctttaccgtctccggtactacctaactaacgttaacaaacgttccacaccgtaacttcgtaacggtaccgtttacgtttcgtaacgttttacgttttacgttcggtactacggtaccgtacgtacggtttacgaacggtacggttacggttacccgggtttacgttacccggttaccgggttaccggggaccggggttaacggaaaccgggtcgggtaacccggtaaccgtaaacgaacggttggaccgttagggaccctacgaccgttaccgtcgtttccgttagttcccttacccgttaccgtacccgttcccgtgttaccgttacg

SEQ ID NO: 5458 - DNA, 808 bp, Homo sapiens
  misc_feature: GYAE6OF01BSZQR.8.28.C06.1.454.CMB.1.raw
  modified_base (176)..(176): a, c, t, g, unknown or other
  misc_feature (176)..(176): n is a, c, g, or t
  modified_base (211)..(211): a, c, t, g, unknown or other
  misc_feature (211)..(211): n is a, c, g, or t
  modified_base (458)..(458): a, c, t, g, unknown or other
  misc_feature (458)..(458): n is a, c, g, or t
tcagctcgcgtgtccacgaccggtgctcgatttagagctcacgtattgggtttgggggaggaactgctcagttaggacccagagggaaccatggaagccccagctcagcttctcttcctcctgctactctggcctcccagtttcagataccacggagagattgtgttgacacatcncagcctaccctgtcttcgtctaccgaggggaaacncgccaccctctccgtgacgacggggccaacggtcaagtaacgttcggttcggccgtaccttaacggttactccgtacgggtaaccaacgaacggtaaacctcgggaccaacgggcccttacccgaacggaccccctcaacttacgtcgttcgggtcactaacctccggaaacgcggggtaccaacgtcgggactaccgtaccgacggaaccgcggtttgaacggttggacctagggtaggggtacgnggggaactacggtacttccgaacttcgtaccaaacgtctacactacgtcgccggtagccgtaccggaggtacggtagttacggttacgtagttttacggtttaattaccgttacgtaaccttaacgtacggttaaccggttaccggtaaccgggttcccgggtacccgggtacccgggggttacctttaaccccggggtttccgggttaaccccggtacgggtaaacccggttaaacggggtaccgtaagttaacccttaaccggtaaaaccgggttaacgtacgggtaccggttcgtacccgggaactaccccgttacgttaccgtttccgttcgtttacccgtaaccg

SEQ ID NO: 5459 - DNA, 724 bp, Homo sapiens
  misc_feature: GYAE6OF01BYZ6Y.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccgngggagagacgccaccctctcctgtcgccggccagtcagagtcgttaggacgtaacttagcctggtatcagcagacggcctggccagggcctacccgagtacctcctactattcgttttcggccgttacccttttaaacgacggggtcctaggtacggaacctccccgaggacccgttagggttaccaacgggccggtacgaacgggtttcggggtaccgttcgggggtaaccttttcggtacctaccttccgtaaccacctactacgtaaactaaccgttcggactaacttcgtacgaccgttactttggaccttaagtttttacttccgttagtacagttacacgttacgtagaaacggttcgttacggtcccggtttcttaccggtttaccggggacgggtaccggggaacttaacggggtacgtacccgtaacgaaaccggtagtagggtacggtccgtacggtccaaccgttagtccgttacgtccttccgtaactttcccgttacccgtcctacgttacccgg

SEQ ID NO: 5460 - DNA, 913 bp, Homo sapiens
  misc_feature: GYAE6OF01A3J16.8.28.C06.1.454.CMB.1.raw
  modified_base (162)..(162): a, c, t, g, unknown or other
  misc_feature (162)..(162): n is a, c, g, or t
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (236)..(236): a, c, t, g, unknown or other
  misc_feature (236)..(236): n is a, c, g, or t
tcagctcgcgtgtccacgaccggtgctcgatttagagctcacgtattggggtttgggggaggaactgctcagttaggacccagacggaaccatggaacgcccagcgcagcttctcttcctcctgctactctggcctcccagagatcattggagaagtggtanatgacacacgtctccggtctaccctgtcttcgttttcggaggganagacncccaccgtctccgtgcgcggaccngacgagtacggtcgttaacggaacgtaacttcggccgttaggtactacgagtacaggaccggtccgtggacctacgggaccctaccgactacccgttacctcgttaccgttccggtttacggtacccgttaacccgtttaaccggaaccggggtcctaacgggttaacggaaccgttccccggaacggtccggtacggttaccgacgggtccggtacggttaacggggttcgggttacccggttacgggggtaccttttcctaacccggtaccgttacctaccctaaacgtaaccttaaccttaaaacccgttaccgtagttacccgttaaacttccggttaaacggtttaccgttaaccttttaacggtacgttttaaccggttttactttaccggtaaccgttacggtaaaccggttccgtaacggttaaccgttaacggaaccggtttcccgggtttaaccgttcccggtttaacccgtttaccgggggttaaccggggttaccgggggaaacccggtaccgggttaaacgggaccccggtttaaacaaccggggttaaacgtcggttaacgggtccgtaaccccggttcgtaaacccctacccgttattcccggttaacttcccgttaaaccttccccgtaacccctttccggtccccttaaacggtaccggg

SEQ ID NO: 5461 - DNA, 797 bp, Homo sapiens
  misc_feature: GYAE6OF01AH4O5.8.28.C06.1.454.CMB.1.raw
  modified_base (422)..(422): a, c, t, g, unknown or other
  misc_feature (422)..(422): n is a, c, g, or t
tcagctcgcgtgtccacgaccggtgctcgatttagagctcacgtattggggtttgggggaggaactgctcagttaggacccagacggaaccatggaacgccccagcgcagcttctcttcctcctgctactctggcctcccagagatcagttgggagaagtggtgatacgacacgcgtccgtccggtacacccgttgttctttcggtttttccggagggggacgtacgaccgtaccctacccttccttccgttgggtaccgccggaccgtagttacgaggtacggtacggttaacggaaccgttaacgttacgtccggttagtactacgacgacgacggccggtcctcgggccgtacggcctaccgacgtcctccgtctacgttcggtcggtcctaccgttagccggtctacggtacgtaccnccgtacgccgtaggtcgacggctacggtggtcggtacggtcgttacgtttacgctaccgtcacgaactactaactacgtaacgtcgactacgtctaacggtcgttacgtacgttactttagtttattccgtagtacctaggtacgtacggttacgttacggacggtacggttccggttacccggtttacggttacccgggttcgggaacccggggttaacgggtaaccggttacggtaaccggttaaacccgtaaggtaaccgggtacgtccgggttacggtacccgttacgtacccgttaagtccgggtttacccgttcgtttacccgttaccgtacccctttaacggcccccgttaaggtcccgttaaccggg

SEQ ID NO: 5462 - DNA, 684 bp, Homo sapiens
  misc_feature: GYAE6OF01D1DN1.8.28.C06.1.454.CMB.1.raw
  modified_base (159)..(159): a, c, t, g, unknown or other
  misc_feature (159)..(159): n is a, c, g, or t
  modified_base (206)..(206): a, c, t, g, unknown or other
  misc_feature (206)..(206): n is a, c, g, or t
  modified_base (637)..(637): a, c, t, g, unknown or other
  misc_feature (637)..(637): n is a, c, g, or t
  modified_base (654)..(654): a, c, t, g, unknown or other
  misc_feature (654)..(654): n is a, c, g, or t
  modified_base (672)..(672): a, c, t, g, unknown or other
  misc_feature (672)..(672): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtnatcgacacagtcctccgtcaccctgttctttggtttttcgagggganagtacgccctaccctctccgtgtcggcggaccagtcaggtagtcgttaacgggactaacgttcgcctaggtactacgagtcgaaggcggccgtcggacccgacggcctaccgacgtaccttcctctacttccgtttcggaccgttaccgtttaacggcgggtacgacggttcggaacctcccgacgtccgtaggttccgacggcggacgtggtacggggttcgtagggtcctttacggtctacgtcctcacgtactacaaacgttcctacgtactaacttcgtacgtacgttactttcggtacttttagtttactttctagtacctacggtacttgtacgtaggtaacgtaccgttcggttaccgttacgtcggttacgggaccgggtacggtacgtaggtccgtaactaccgtaaacgtcgtggtcgtcncgtacacgtctacgttntacccttactccttaccnccgtctgtaacg

SEQ ID NO: 5463 - DNA, 679 bp, Homo sapiens
  misc_feature: GYAE6OF01BGTBZ.8.28.C06.1.454.CMB.1.raw
  modified_base (197)..(197): a, c, t, g, unknown or other
  misc_feature (197)..(197): n is a, c, g, or t
  modified_base (639)..(639): a, c, t, g, unknown or other
  misc_feature (639)..(639): n is a, c, g, or t
  modified_base (660)..(660): a, c, t, g, unknown or other
  misc_feature (660)..(660): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatcgacacagtctccggtcaccctgttcttgttttccgnggggagagacgccacctctccgtgtcgcgcagtcagagtcgttaaggaactaacttagccgttaggatcaggacgagacggccgtcggaccgaggcctacccgaagtcctccgtctacgtttcgttaggaccgttaccgttaacgacgggtccaaggtacgaacctaccgacgaccgtacggtcacgggccggcgtaggtcgggttaccgtggggttaccttcgtaccaccttacgacctaaaccacgtaactaaaccgttaaccgcgtaactacgttacgtaccgtaacgttacgtttacgtcttttaacgttttattccgttaggtaccaggtactacggttacgaggtaaacgttccggtcggtaccgtttaacgtacggttccgggacgggtaacggtaccgtagggtacctaccgaaccgaagtacggtggcgtacncgactcgacttcgtatctacncgttaccctaccgctgtcg

SEQ ID NO: 5464 - DNA, 776 bp, Homo sapiens
  misc_feature: GYAE6OF01EJ8HG.8.28.C06.1.454.CMB.1.raw
tcagctcgcgtgtccacgaccggtgctcgatttagagctcacgtattgggtttgggggaggaactgctcagttaggacccagacggaaccatggaaggccccagcgcagcttctcttcctcctgctactctggctcccagacgatcattggagaagtggtgatgacacagtctcggtcaccctgtctgttttcctgggagagtagccacccgtctccgtgtgccggccagtcagagcgttacggactaacttagccgtggtatcagcgagacggccgtggccgaggcctcccagacctcctctatcgtttcggctacccgttttaacgagggacccgaggtcggaacctccccgagtacgacgggtttacacggacggccgtaagggtcgggttagtacggggtaccgtttacggtttcgaaccttccgtacctaaacccattaacccgaaaacctttaaaccctcggtaccttaaacgtccgttacgtaaccgggtactttttgaaccgtttaagttttaactttttccgtagttccgaaggttctacgtttaccgtaaggaacggttaaccttcgggtacccggtttcgttaaccggttttccggggacgggggtaacccggttaaaccgggaaccgggttacggtaacccgttaaccctaaaacgggtaaccgtccgggtaaggtcccgtgtacccgttaacctacgtttccgttccgtttacctttacccgtacgttttaccccccttacccgtacccttacgttaccccgg

SEQ ID NO: 5465 - DNA, 897 bp, Homo sapiens
  misc_feature: GYAE6OF01C3HG9.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagccccagcgcagcttctcttccctcctgctactctggctcccagagatcattgggagaagtggtgatgacacagtctccggtcacctgtcttgtttttccgnggggagagacgccaccctctcctgtgccggccagtcagagcgttaaggactaacgttagcctggtactcgagaccagagggcctaggccgaggtcctcccgaagacctcctcctaatttccgtttggaccgtcccttttaaacggacggggccctaggtacggaacttaccccgaggtaccccgtaggttacgacggacggtacgaggggttcggggtccgtttacggggggtccctttttaccggtaccgtaccgttccctacccgtaaacccttaacgttaaccccgtaaaactttaaccccgttaggtacccgtaaacgtttcccggttaaaccggttaacccgttttaccgtttttacggggaccttttaaccgggttttttaactttttacccggttcggttaccgtaaaccgggttccgttaacgggtacgttaacgggaaacggttaacccgtttcccggggtttaccccgtttaccgggtttaaccggtttccccgggggaacgggggttaaccggggtaacccggtaacgggggttaccggtaacccgtaaaccgggtaaaacccgggtacgtttacgggaccggtttacccggtacggttcccaaacgtttacgttcccgtttacggttaccctttaaccggttaccctttaccccggtttacccccggtaccgttccggttaacccgg

SEQ ID NO: 5466 - DNA, 816 bp, Homo sapiens
  misc_feature: GYAE6OF01A4GT9.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtcctccggtcaccctgtctgtttttccgnggggagagacgccctaccctctccgtgtcgcggccagtcagacgtcggttaacggacgtaacttacgccgtaggtactcgacgacgaaggacgggccctgggcccgaacggtcccttacccgaacggtacccttccccgtagtaactttccggtttcgggaccgttacccgttttaaacggcggggtaccctaggtacgggtaaacctcccccgaagtcccgtaaggttccgaacgggtccggaccgtaagggttccggggttaccgtacggggttaccctttaccggttaccacccgttaccgtacccaaaccctaacgttaactaaaaccgttacccgacggtaacctaacgttccgtaacggtaccgtttaactttcgggttaaccctttaaggttttactttcgtaacggtccgacgttacggtacgtttaccgtaggaaacgttccggtccgggttaccgtttaccgtaacgggtcccggggtaaggggtaaccgggtaaccgtaacgggttcgaacccgtaacggaaaccgtaagttccggagtccgtagtacccggtacacggttccgttacgttaccctacgaccgtttccccgacccgtattcgtaccgg

SEQ ID NO: 5467 - DNA, 696 bp, Homo sapiens
  misc_feature: GYAE6OF01CLTO3.8.28.C06.1.454.CMB.1.raw
  modified_base (157)..(157): a, c, t, g, unknown or other
  misc_feature (157)..(157): n is a, c, g, or t
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (431)..(431): a, c, t, g, unknown or other
  misc_feature (431)..(431): n is a, c, g, or t
  modified_base (680)..(680): a, c, t, g, unknown or other
  misc_feature (680)..(680): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcatggagaagtggtnatgacacagtctccggtcaccctgtctgttttccgngggganagacgccaccctntcctgtcgccggcagtcagngccgttaaggacgtaacttagcctggtacncagcaggnggacctggccaggcctccagactccncatcgtttggcctcctttaacgaggtaccctaggtacggaacttccgacgacccgtaggttcaacggcggaccgtaggttcggggtactcggggtactttccggttctactcgtaccacactacgaaacttaccnggtactaactcgacgtacgtaacgtttcgtacttaagtttactttcttctaccgaacgtgtaacgttctacggtaaacggtacttcgggaccctttagtaccgtttacggggacgggtacgggtaaaccggtaagggttaccgggtaccctaacggtaaaaacggtaccgttaggtacgggtacgtccgtaacgtaacccgtaactaccggttacttacccgttctaacggttccgtttaacccccgtnttaacccggtacccgg

SEQ ID NO: 5468 - DNA, 847 bp, Homo sapiens
  misc_feature: GYAE6OF01ER67L.8.28.C06.1.454.CMB.1.raw
  modified_base (210)..(210): a, c, t, g, unknown or other
  misc_feature (210)..(210): n is a, c, g, or t
  modified_base (591)..(591): a, c, t, g, unknown or other
  misc_feature (591)..(591): n is a, c, g, or t
tcagctcgcgtgtccacgaccggtgctcgatttagagctcacgtattggggtttgggggaggaactgctcagttaggacccagacggaaccatggaacgccccagcgcagcttctcttcctcctgctactctggcctcccagagatctagttggagaagtggtgatgacacgtagtcgtccggtcacccgttgttctttggtttttccgnggggacagaccgtccctacccgttctccgtggtccgcggtccacggtacaggtacgtcggttaaacggaaccgttaagtttcggccgtttaggtacacaacggtacaacggggtaccggtccggtacggtacccggacggtacccttaacccgaacgttaccctccccgttacgttaaccgtttccggggtttaaccggggtacccttaacccggttttaaacgggaccggggtaacccgtaaggtaccggggtaaacctccccggaggtaccgttacgggtaccgaagggccggtaggtacggggtccgggttaggtaccggggtttccttacggtctaccgtcctaaccgtacctaactaaacgttaaccgtaaccgtnaaccgtacgttacgtaccggttacgttaactttcggtaacgttttacgtttactttcgtcgtacgtactcggttaagtacgttaaggaccggttacgtcggttacccgttccgtacgggtttaccgggaacgggtaccgggaaccgtaacgggtacctaacggtaaaccgtaacgtacggttcggacgtcgttaccgacttaacggcgtttccgtacgttccttacgaccccgtttccgacccgttcgcgttaacg

SEQ ID NO: 5469 - DNA, 793 bp, Homo sapiens
  misc_feature: GYAE6OF01BXU0X.8.28.C06.1.454.CMB.1.raw
  modified_base (142)..(142): a, c, t, g, unknown or other
  misc_feature (142)..(142): n is a, c, g, or t
  modified_base (202)..(202): a, c, t, g, unknown or other
  misc_feature (202)..(202): n is a, c, g, or t
  modified_base (396)..(396): a, c, t, g, unknown or other
  misc_feature (396)..(396): n is a, c, g, or t
  modified_base (456)..(456): a, c, t, g, unknown or other
  misc_feature (456)..(456): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccaganatcattggagaagtggtgatgacacagtccgtccggtcacccttgtctttcgtttttcgnggggagagacgccacccttctcctgtcgacgcctagtcaggagtacggttaaggacgtaacttacggccttggtactcagtccaaggacggccctggcccaggcctcccagtacctcctctattcgtttcggccgtaccctttaacggacgggcctaggtacggacctcccgacgccgtaggttcaggccgganacggtgggtctggggttcttccgttccgacttccgactacctaataccgaaacgttaccngtaactaacgtccttaggtaccgttaacgtttgtacttttaacggtttaactttcttacggtctaacgttcgaacggtttacgagtaaaccggtcgtttaccgggttacccgtttaccgttaacgggttcccggggtaacgggggaaccgggttaaaccggtacccggggttaacgggtaaccccttaaacgggtaaaaacccgtcgggtttacgggtaacgggaccctttacgggaacccccttacgttccgttaccggtttaccccggtttaccgtttaccgttacccccgtttacccccgtttacccccggtaattaccccggtttaacccggg

SEQ ID NO: 5470 - DNA, 731 bp, Homo sapiens
  misc_feature: GYAE6OF01B9S8J.8.28.C06.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (492)..(492): a, c, t, g, unknown or other
  misc_feature (492)..(492): n is a, c, g, or t
  modified_base (680)..(680): a, c, t, g, unknown or other
  misc_feature (680)..(680): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcagttggagaagtggtgatgacacagtctccggtcaccgtgtcttgttttccgngggganagacgccctacctctcgtgtcgccgcctagtcaggacggtaccggtaaggaccgtaaacgttcggccgtagggtatacgaggccgaggacgggtcccgtagggaccccgtacgggcccacccgaggtaccccttccctataccgtttcgtttcgggacccgtttaccgttaacggcggggacctaaggtcggaacctccccgagcccgtaggttcgaggccgcggaggttcgggtcgtaggtacctttcgtctactttcaccgtactacttactaaaacgcccgttanacctactacgtcgtacgttacgttcgtacgttagttttacgttacgtcgtacgtacgtacgtacgtacgtagtaaccgtcgtaccggttccgttcgttacggttccggggacgggtaccggaaccggtaggtacccggtaacgtaccgtaaaccgtcgtcggtacgtcgtacccgtactaaccggttnttcccgttacgtacccgttcttaccgtaccccttccctacgtacgtaccgg

SEQ ID NO: 5471 - DNA, 856 bp, Homo sapiens
  misc_feature: GYAE6OF01CFJVC.8.28.C06.1.454.CMB.1.raw
  modified_base (169)..(169): a, c, t, g, unknown or other
  misc_feature (169)..(169): n is a, c, g, or t
  modified_base (846)..(846): a, c, t, g, unknown or other
  misc_feature (846)..(846): n is a, c, g, or t
tcagctcgcgtgtccacgaccggtgctcgatttagagctcacgtattgggtttggggaggaactgctcagttaggacccagacggaaccatggaacgccccagcgcagcttctcttcctcctgctactctggcctccagagatcagttggagaagtggtgatgacacgngtcctccggtccaccgtgttcttggtttttccggagggggatacgacgaccctcccttcgtccgtggtaccggccggccgtagtacgaaggtacggttacggttaacggaaaccttaagttaccggccgttaggtacgttcgaacggtacgacgggtaccggtcccgtacggaccgaaccggtcccttaccgaaacgtacccgtccttacgtaccgtttaccgtttacggaccgttaacccgtttaacggacggtaccctagggtaaccgttaacctccccgaaggtcccgtaacgggttcgacggtccggtacgttcgggttacgggtccgtaacggggttacctttcggtacccaccgttacctaaccaccgttaacgtaccaaaccgttttacccgacgtaaccgttaacttccgttacgttaaccggttacctttacgttaccgtttaacgttttcgttaaccgttcgttaccgtaacgttccgtaacgttacgtagggtaaccttcgggttaaccggttcccgtttacggttaccggttaccgggtaccgggtaaccgggtaccggttaacgggtacccgtaacggtaaccggtaaacgtcggtacggtcgtaccggtacaccggtacctcgttaccgttcggttaaccttccgtacctttcccgtcccgtntccgtaccgg

SEQ ID NO: 5472 - DNA, 965 bp, Homo sapiens
  misc_feature: GYAE6OF01AN9GT.8.28.C06.1.454.CMB.1.raw
tcagctcgcgtgtccacgaccggtgctcgatttagagctcacgtattgggtttgggggaggaactgctcagttaggacccagacggaaccatggaacgccccagcgcagcttctcttcctcctgctactcgtgcctccagagatcagttggagtaagttgttagatagaccacgtacgttccgtcccggtacctacccgttgttccgttttggttttttcccgggagggggacgacggaccgtcccctaccccttcgttccgtcggtcgacccgggaccctaggtacgaaggtaccggttacggtttaacgggaaccgttaacggttcgtcccggtttagggttacacggaacggaccgaaggtccggcccgttacggaccgtaacccggcccttaccgacgttaccccttaccctacggttacgttttcccggttaccggggtaacccgtttaccccgttttaaaacgggcccggggtacccgtaaggggttttaaccccggaaccctttacccccggacggtacccgggttttaaccggtaccggaccggggtacccggggtacgggttacggggttttccggggttaccgtttaacggggtttacccccgtttccgttaaacctaaccgtttccccaaaccgtaccgtaactttaaacccgtaaaccgtccttacgtacctaacgttacccgttacgtaaccgtttcgtttaacgtacttttacggtttacttccgtagtaccgtagttacgttaccggttagttaaccggtacgttcggtttacccggtttaccgttaccgggttcgttaacccggggtacgggtaacggttaacggacgttaacccggacccgtaaacgaaccggtcggttcgtaccgaccgtacgtaccctacgttcccgtacgttcccgtttacgtacccgtttccccgtcccgttaacccgttgtaacccgttccgg

SEQ ID NO: 5473 - DNA, 834 bp, Homo sapiens
  misc_feature: GYAE6OF01AQJF8.8.28.C06.1.454.CMB.1.raw
  modified_base (168)..(168): a, c, t, g, unknown or other
  misc_feature (168)..(168): n is a, c, g, or t
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (492)..(492): a, c, t, g, unknown or other
  misc_feature (492)..(492): n is a, c, g, or t
tcagctcgcgtgtccacgaccggtgctcgatttagagctcacgtattgggtttgggggagggaactgctcagttaggacccagacggaaccatggaagccccagcgcagcttctcttcctcctgctactctggcctcccagagatcattggagaagtggtgatgacangtctcggtcaccctgtcttgttttccgngggganagacgcctaccctctcctgcgccgctagtcaggtagcggttaacggacgtaacttagccgttggtactcgacgacgacggaggcccgtaggcccgaaggcctaccccgagacccttcctcgtacgtttccgtttcggacccgttaccgtttaacccggagggtccgtaaggtcgtaaaccctcccgaacggtacgtacggttacgcggaccggtacgacggttcggggtacgtacggggtctttcggtcctacgtcctacgtacctaacgtactaaaccttacccggtanaccgttaacgtccgttaaggtccgttaacgttttaccgtacgtttaaagttttccgttttaccgttacggtttacctaggttaaccgtaccgtttaataccgggtaaacgttacggtttccggttaccggtttacccgttaccgggttacggggtacccgggttaacgggaaccccggttaagggttacccggaaccccgttagggtaaaccccggtaagggttcccggtacgggttacccgttaacccgggtaccaacccggtttacgttaaccggtttcccgttaaccccgttacgttcccccgtttaaaccggttcccccctacgtttcggtaacccgg

SEQ ID NO: 5474 - DNA, 777 bp, Homo sapiens
  misc_feature: GYAE6OF01B2Z9E.8.28.C06.1.454.CMB.1.raw
  modified_base (141)..(141): a, c, t, g, unknown or other
  misc_feature (141)..(141): n is a, c, g, or t
  modified_base (167)..(167): a, c, t, g, unknown or other
  misc_feature (167)..(167): n is a, c, g, or t
  modified_base (205)..(205): a, c, t, g, unknown or other
  misc_feature (205)..(205): n is a, c, g, or t
  modified_base (485)..(485): a, c, t, g, unknown or other
  misc_feature (485)..(485): n is a, c, g, or t
  modified_base (504)..(504): a, c, t, g, unknown or other
  misc_feature (504)..(504): n is a, c, g, or t
tcagctcgcgtgtccacgaccggtgctcgatttagagctcacgtattggggtttgggggaggaactgctcagttaggacccagacggaaccatggaagcccagcgcagcttctcttcctcctgctactctggctccagagntcattgggagaagtggtgatgacacngtctccggtcacctgtcttgttttcgagggagacgacnccactcgtctggtcgcgctagtacgagtacgtacgtaaggactaacgttcgccgttaggtactcgaacggtacgaaggcggcctcgggacccgtacggcctacccgtacgtacccttccgtactacggtttcgtttacggaccgtttacccgtttaaacggcgggtacctaagggttaccgaaaccttcccggaaacgtcccggtaggttccgaacgggtcggacgttagggttcgggcgttacggggttacctttcgtcctaacgtccgaacaacctanaaacgtaaacttaaccgtnaacgttacgtacgtaacgtaccgtttacgttagtacgtttacgttttcttaacttagtccgtagtacgttaactacggtaacggtacgtacggttccgttaccggtttattacccggggttacgggtacggggacggtaaccggttaacgggttaccgaaccgttaacgaaacggttaccggtacgggaccttaccggcgtaacctaacccgtttcttacggttcgttaacccttccgttacgttaccccgtacccgtccgttaatacccggg

SEQ ID NO: 5475 - DNA, 799 bp, Homo sapiens
  misc_feature: GYAE6OF01EDO53.8.28.C06.1.454.CMB.1.raw
  modified_base (225)..(225): a, c, t, g, unknown or other
  misc_feature (225)..(225): n is a, c, g, or t
tcagctcgcgtgtccacgaccggtgctcgatttagagctcacgtattggggtttgggggaggaactgctcagttaggacccagacggaaccatggaacgccccagcgcagcttctcttcctcctgctactctggcctcccgagagatctagttggagtaaggtgggtgatagacacgtacgtccgtcccggtaccacccgttgttccgtttacggtttttccggnggggagacgaccgcccctaccctcgtccgtggtcggccggacctagtacgagacggtacggttaacggaaccgtaacgtccgccgttaggtactcgacgacgacggtccggccgcggaccgacgcctaccgacgtcctcctcgtcgttcggttccggtaccgttaaccgttaccggcggtacgtacggtaccgtaccgtaccgacggtcgtacggtcggacggtcggtacggtacgggttccgggttcggttaccgggttaccgttccgttacctaccgtacccgtaacctaaccgtaactaaacctaaccgtacctacgtaactaacgttcgtacgttacgttacgtttacgttacgtttacgtttcgttcgtacgtacgtacgtacgttacgtaacggtacgtaccgttcggttccggtaccgttaccggttaccgggtaccgggtaaccgggtaaccggtaaccgttaacggtaccgtaaccgtaacggtaacgtcggtacgtacgtcgtaccgtacctacgttcttaccgttccgttacctcccgttacctcccgtcctacgtccgtacg

SEQ ID NO: 5476 - DNA, 821 bp, Homo sapiens
  misc_feature: GYAE6OF01AKC6F.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggcctcccagagatcattggaagtaaggtggtgatgacacagttcctaccggtcacccttgttactttcggtttttccgagggggacacgacgccctaccctctccgtggtcgccggcctagtcgaggtacgtcggttaaggaaccgttaacgttcgccgttaggtactcgacgcgaggacgccgtaggccgacggtcctaccgacgtccctaccgtactagtttccgtttacgggtacccttaacgtttaaaccggacggggtccctaaagggtacccggtaaaccttccccggaaggtcccggtaacggttcgaacgggccggtacgtagggttcgggtacgtcgggttacctttccggtactccgtccgtaccaccgttaacgtaacctaacttaacgcgtaacgtaacgtacgtaacgttaccgttacgtttacgttacgtttaacgttttacgttaccgttacgtacgtacgtacgttacgtacgtacggtaaccggttaccggttccgggttacccggtttaccggttaccgggttacggggacccgggtaaccgggtaccggttaacgggtaccgtaaccggtaccggtaaaccgtcggttacggtcgtacgtccgtaccgtaaccgttcgttaccgttcgttacctacgttcccgttaacccgttccctaccgtacgtacccgg

SEQ ID NO: 5477 - DNA, 825 bp, Homo sapiens
  misc_feature: GYAE6OF01BXYHY.8.28.C06.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcagttggagaagtggtgatagacacagtcctccggtcaccctgtctttgtttttccggnggggagacgacgccctaccctctccgtgtcgccgaccngtcaggtaggcgttaaggaaccgtaacttgccgtaggtactacgagcaggacgccgtggaccgagcctccgacgtcctcctctacgttcgtttcggaccgttaccgttaaacggacggggtcctaggtacggtaaccctcccgaaggtacccggttacggttaccgacgggtccggtacggtagggttcgggtacggttacgggttacctttccgtaccctccgttccaacccgtacctaacgtaacaaaccgttaccgtacgtaaccgtaaccgttcgtaccggttaaccgttactttaccggtacgtttaacgttttcgtttacgttccgtactacggtaccgttaacggttccgtaacgtaacggtaccggttaccgggttaccgtttaccgttaaccggggtttacgggaccggggttaacgggtaacccggttaacggggtaccgtaacccgtaacgtaaaccgggtcggttaccggtacggtaccggttccgtacttacccggttacgttacccgttacggtttacccttaccggttacccgttaccccgttacccccggtaattcccggttaaccgg

SEQ ID NO: 5478 - DNA, 834 bp, Homo sapiens
  misc_feature: GYAE6OF01EY26S.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgattttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagacgcccaccctctcctgtgcggccagtcagagcgttaggacgtaacttgcctggtatcagcagaggccgtggcccaggcctcccgagacctcctctacttcgtttcgggccgtaccgttttaacgacgggggtcccaaggtacggaacttacccccgacggtacccgtaagggtttccgaacgggtccgggtacgtaacgggttcggggttacgtcggggttaacctttcccggtttacctaaccgttcccttaccgacccctaaacgttaacccgtaaacttaaaccccgttacgaaccgttaaacttccgttacgggtaacccgttaaccggtttttacgtaccgtttaagttttttacctttcgttacggttacctaaggtaccgtagtttaccggtaaggttaacgtaccggttacgggttaccggtttaccgttaaccggtttccggggaccggggttaacggggtacccggtaaacggggtttaccgggaacccgtttaaccgaaaacgggttaaccgttagggttaccgggtacgttccggtacccgtaaccttacgttaccgttaccgttacccgtttacctacctttaccccgtttccccgtcccgtaaccgttacccgg

SEQ ID NO: 5479 - DNA, 948 bp, Homo sapiens
  misc_feature: GYAE6OF01BW5VX.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaaggtggtgatgacacagtctccggtcaccctgtcttggtttttcgtggggagagacgccaccctctcctgtggcggccagtcgagagtcggttaagggaccgtaacttacggccttggtactacgaggcgtaaggacgggtcccgtagggcccacgggccctaccccgacgtaacccttccctactacgtttcggttttccggggtacccgttacccgttttaaaccggaccggggtacccgtaagggttaccgggaaaccgttccccgaacggtacccggtaacggttccgacgggccggacggttaacgggtcgggggttaccgttacggggggttacccttttcgggtttaacccctacgtttcccgtaccctaacctaacgtaacctaaaaccgttaaaccccgtgtaaacctaacgttccgttaacgggtaaccttaaccgttttcgtaacgtttagtttttaacgtttcgttacggtctaacggtacgttacgtttacgaaggttaacggtccgttacggtcccgttttacggtacccgggttttacggggggaacccgggggttaaaggggtaaacccgggttaacggggttaacccgggtaaaccccgttaaaaccgggtaaaaaccccggtttaggggttaccggtaacgggggttaacccgtcccggtttaaccccggaaacccggtttacggtttacccggttttaccggtttcccgttttaaccccgtttaacccgttttacccccgggttttcccccgaacccgtttaaccgttaaccccggg

SEQ ID NO: 5480 - DNA, 848 bp, Homo sapiens
  misc_feature: GYAE6OF01B3Z3O.8.28.C06.1.454.CMB.1.raw
  modified_base (216)..(216): a, c, t, g, unknown or other
  misc_feature (216)..(216): n is a, c, g, or t
  modified_base (794)..(794): a, c, t, g, unknown or other
  misc_feature (794)..(794): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagaatcattaggagtaagtggtagatgacactagtcgtccggtcctacccttgtcgtttgtttttccggagggganagcgtcccaccctcgtccgtgtcggcgtccacgtcagacggtcgttaacggaaccgtaattacggccgttaggtactccgaagtccgaaggtaccggtcccgtacgggacccgttacgggaccctacccgaacgtaccctttcccacgtttaccggtttccggttttaccgggtacccgtttaacccggttttaaacgggaccgggggtaccgtaacgggttacgggtaaaccctcccggtaaccgggtacccggttacggggtttaccaaccgggccggggtacggtaacggggttccgggttaccggggttaccgggtttaacccgttttccgtttaccccggtaacctttacccggtacctacccggttaaacgtaaacctaaaacccggtttaaccgtacgtaaccgttaaccgttcggttaacgtaaccgtttaacgttttcgtaacgttttacgtttttaatttccggttatacgtagtcgttaacgtcgtaacgtacgttacggtcgtaccgttcgttacggttacggcgggtaacggtacgtacggtacgtacctaacgtaacgtacggngtcgtacgcgtactactacgtcttgttcctctaccttcccgtcctacgtcgtcg

SEQ ID NO: 5481 - DNA, 846 bp, Homo sapiens
  misc_feature: GYAE6OF01CT5S4.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
tcagctcgcgtgtccacgaccggtgctcgatttagagctcacgtattggggtttgggggaggaactgctcagttaggacccagacggaaccatggaagcccagcgcagcttctcttcctcctgctactctggctccagagatcattggaagaagtggtgatgacacagtctccggtcacctgtcttgtttttccgngggganagacgccctacctctcctgtcgacggccagtcagacgtcgttaagactaacttcgctggtacncagcagcgcgtcggaccacggtcctccgagtacctccctatacgtttcgtttacggaccgttacccttttaaacgggaccggtaccgtagggtacgtaaccgttacccacggtaccgtcgggttaccgacgggacgggtaccgtagggttcgggttccggtacggggttaaccttttccggttaaccctccggtttaacctacctaaccgttaaactaacccttaaacgtttaaacccggactaaccgttaacttaccggtacggttaacgtttacgtttacgtttacgttttaacgtttttacgtttaccgttcgtttacgaaccggttacgtttaacggtttaccggttacgttaaaaccgggttccggtttaccgggtttacccgttttacccggttacgggttttacccggggaacgggggtaccgggtaaaccgggttaacgggtacccggttaaaccggtaaccgtaaaaccggtaccggttcggtaccggtacgttaccgaccgttaactcgtttaccgttagttacccgttactttaccggttaccccttaccccgtaacgtcgttaacccgg

SEQ ID NO: 5482 - DNA, 721 bp, Homo sapiens
  misc_feature: GYAE6OF01A5DWT.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccaccctctcctgtcgcggccagtcagacgcgttaggacgtaacttgccgtggtatcagcaaggacggcctggaccaggtcctacccgaagtacctcctactacgttcgtttcgggccgttaccgtttaaacggacgggtaccgtaggtacggaaaccttccccgaaggtacccgtagggtttaccgacgggaccggtacgtacgggttcggggtaccggttcgggggtaaccttttccgggtttacctaaccgtccttaccgaaccctaacgttaccaaactttaaacccgtgaacctaaacgttcgtacgtaaccgttaacgtttcgtacttaaggttttactttcgttacgttacgtacgtcgtagttacgtacggtaacgtacgtcggtaccgttcgtaccgtttcgggacgggtaacggaccgtagggtacgtacgtacgaaacgtacgtcgtagacgtcgaccacgtcttcgtacttccttactacttaccctccgtccgtagtccg

SEQ ID NO: 5483 - DNA, 1050 bp, Homo sapiens
  misc_feature: GYAE6OF01ANPF5.8.28.C06.1.454.CMB.1.raw
tcagctcgcgtgtccacgaccggtgctcgatttagagctcacgtattgggtttggggggaggaactgctcagttaggacccagacggaaccatggaacgccccagcgcagcttctcttcctcctgctactcgtggcctccagagatctagttaggagtaaggtggtagagtacggaaccacgtacgttccgtcccgggtccctaccccgttcgttccgttttcggtttttcccgggtaggggggacggacggtaccgccccgtaccccttccgttcccgtcggtccggaccggtcccgtaaggtccgaacggacgggtacgggtttaaaccgggtaaaccggtttaaaccgttaccggacccgtttacgggtaactaccggaacggaccggaacgggtaccgggtccccggttacggggccccgtaaccgggtccccttaccccgaaccggttaccccttaaccccgtttacgttacccgttttcccggtttttaccggggtaacccccgtttaacccggtttaaacgggtaccggggtacccgttaacgggttaaccgggtaccccgttaaccccgccgggttacccgggttaacgggttaccggaccgggtaccggggtaccggtaggggtttccggggggttaccgggttttaaccggggtaccgttttaccgtaccccgtcctttacccggaaccctttacccgtaaactttaacccgtaaacccgttaaccgttacggacccttaacgttaccggttacgtaacgttttaccgttcgtttacgtttttacggttttacgtttaccgtacggtacttacgttcgttaacggttcggaacgtacgggtcccgttaccgggtttaccgttcgtttaacccggggttaccggtacggggtaacccgggttaacggtaaccgggttaacccgtaccggaaccggttaacggtcgttacgggaccgttcccggtacgacccgttacgtttacggttaccctttcgtccggttaacccttcccgttaacccggttccctaccttgggtaccg

SEQ ID NO: 5484 - DNA, 812 bp, Homo sapiens
  misc_feature: GYAE6OF01B3L49.8.28.C06.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (289)..(289): a, c, t, g, unknown or other
  misc_feature (289)..(289): n is a, c, g, or t
tcagctcgcgtgtccacgaccggtgctcgatttagagctcacgtattgggtttgggggaggaactgctcagttacggacccagacggaaccatggaacgccccagcgcagcttctcttcctcctgctactcgtggcctaccagagatcagttggagaagtggtgatgacacagtcctccggtccaccgttgttcgtttcggtttttccgnggggagacgaccncctacctctcgtgtcgcggccagtcgaggtacgtacggtaacggactaacgttccgcgtaggtacncgagcgaacggcggtccgcggaccgtacggccctacccgactccctcctacgttcgtttaccggttacggacccgtttaccgttaaccggcggtaccgtaaggtacggtaaccctccggacgtaccgtacggtacgacggtcggacggtcgggtggtccgtagggttccttcggcctaccgttcgaccgtacacgtaacgttaactaacgtcctaacgtacctcgtacggtacctttacgtacgttaacttttacggttttaaccgttcgtaacgttacgtacggttacgtaaacgttcggtaaaccggtaccgggttacgggtttaccggttacccggtttacggtaacccggggtttacccgggacggggttaaccgtaacccggtaacgggtacccgtaaccggtaacggttaaacggtacggtcgtaacgggcctacggtacccttaccgtacggtttcccgtacgtttaaccccgtcgttaaccccttaccccgggttacctacggttccgaaccggg

SEQ ID NO: 5485 - DNA, 717 bp, Homo sapiens
  misc_feature: GYAE6OF01AIBK4.8.28.C06.1.454.CMB.1.raw
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (431)..(431): a, c, t, g, unknown or other
  misc_feature (431)..(431): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatagacacagtcgtccggtcaccctgttcttgttttccgngggganagacncctacctctccgtgngcggccagtcaggacgtagtacggacgtaacttgccgttaggactcgagaccgaggacggccgtaggccgacggcctcccgaagtccctcctatacgtttcgttacggcccttaccttaacggacggtactagggtacggaacctcccgaggtccgtacggttcgacggtcggacgtggttcggtccgtagggtccttccggtcncctcgaccaccgtataacccgaattaccgactactacgtctacgtacgttaccttagtcgtttagtttacttcgttactcgtacgacgttacgtacgtacgtaacggtcgttccgttacggtttaccgtacggttcggggacgggtaaccggtacggtaacggtaccgtaacccgtaacgaaaaccgggttccgttacgggaccggttacgtcccggtaaccctacgttaccgtcccgttcgttaccttcgtacccgtttacccgtacccacgttaccgtaccggg

SEQ ID NO: 5486 - DNA, 857 bp, Homo sapiens
  misc_feature: GYAE6OF01A8ZOS.8.28.C06.1.454.CMB.1.raw
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (579)..(579): a, c, t, g, unknown or other
  misc_feature (579)..(579): n is a, c, g, or t
  modified_base (664)..(664): a, c, t, g, unknown or other
  misc_feature (664)..(664): n is a, c, g, or t
tcagctcgcgtgtccacgaccggtgctcgatttagagctcacgtattggggtttgggggaggaactgctcagttaggacccagacggaaccatggaacgccccagcgcagcttctcttcctcctgctactctggcctccagagatcagttggagaaggtggtagatgacacagtccgtccggtccaccgtgttcgtttcggtttttccggngggganagccgccctacccttcgtccgtggtcggccgaccgtagcgaggacggtacggttaacggaaccgtaacttcggccgttaggtacgtccgaggtacgagggtaccggtccggtcggaacccgtacgggttccctaacccgtacggtacccctttaccgttacgttaccgttttcggtttaccggggacccctttaaccggttttaaccgggaccggggtacctacggtaaccggtaacccgtacccggaccggttaccggtacggttaacgcgggtcccggtaggtacgggttcggggtacccgtttaggggttcccttcggtttcccaccgttccaccaaactcgtaacctaaaacggtacncgtaacttacggtactacggtaccgttacgttagttaccgtttaacgttttcgttagtaccgtacgtacggtcgtttaaacccgnggttaacggtaacccgtttcggtaccggtttaccggtccggtttacgggttaccggggtaccggggtaaccgggtacggtacgggtaacccggtacgttaaccgaacggttcgtccgtacggtcgaacgaccgttaccgtgttacccgtcgttacccttaccttacccggttcctaaccccgtgcccgttacg

SEQ ID NO: 5487 - DNA, 716 bp, Homo sapiens
  misc_feature: GYAE6OF01AUFZJ.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctccagaaatcattggagaagtggtgatgacacagtctccggtcaccctgtcttgttttccgtggggagagcgccaccctctcctgtgcggccagtcagagcgttaggacgaacttagcctggtatcgagcgagacggcctggccaggcctcccagtacctcctctacttcgtttggccgtacctttaacgacgggccaggtacggaaactccccgagacccgtagggttccaggtccggcgtagggttcgggttccgtacggggtacctttccgttctaaccttccgtaccacctacgtacctaaactaccctgtactaacttcgtacgtacgttactttcgtacctttaagttttactttcgttgtccgtacgtacgtacgttcgtaggtaacgtcgttcggtcccgtttacgtaccgtttaccggggacgggtaacgggtaaccgtaacgggtaccggtaacccgtaaccgtaaaccggtacgttcggtacggtaccgtacggtccctaacgttacgttcgttccgttacctttctaacccgtttccccgtttaccccgaccgttacgttccgtaaccggg

SEQ ID NO: 5488 - DNA, 720 bp, Homo sapiens
  misc_feature: GYAE6OF01D0940.8.28.C06.1.454.CMB.1.raw
  modified_base (161)..(161): a, c, t, g, unknown or other
  misc_feature (161)..(161): n is a, c, g, or t
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggacggaactgctcagttaggacccagacggaaccagtggaagccccagccgcagcttctcttcctcctgctactctggctcccagagatcattggagaagtggtnatgacactagtctccggtcaccctgttccttgtttttcccgnggggagtanacgcccaccctctcctggtcgccggaccagtcaggacgtcgttaggacctaagttgtccgtggtatcgagcagacggtccgtcggccagggcctacccgacgtaccttcccgtactacttcgtttaccggcgtacccgtttaacgacgggtccaggtacggacttccccaacgccctaggttccaacggtccggtacgaggttacgggtccgtacgggtaacctttcgtaccgtacctccgtacacccaattacctaaaccttaacctacgaaccgtaattccgtagtaccgttactttcgtacttaagttttacgttcgtacgtactacggtcgtacgttacgtacgtacgtaccgtccgttacccgtccgttacccggttacgggaccgggtaaccggaaccgttaacgggtacgtacccgacgtaaacggtaaccgtcggtaacgtcgtacggacctacgtcgtacttccttacctctaccgttcccctacccgctccgtaccgg

SEQ ID NO: 5489 - DNA, 775 bp, Homo sapiens
  misc_feature: GYAE6OF01BO5DD.8.28.C06.1.454.CMB.1.raw
  modified_base (584)..(584): a, c, t, g, unknown or other
  misc_feature (584)..(584): n is a, c, g, or t
  modified_base (731)..(731): a, c, t, g, unknown or other
  misc_feature (731)..(731): n is a, c, g, or t
  modified_base (768)..(768): a, c, t, g, unknown or other
  misc_feature (768)..(768): n is a, c, g, or t
tcagctcgcgtgtccacgaccggtgctcgatttagagctcacgtattgggtttgggggaggaactgctcagttaggacccagacggaaccatggaacgcccagcgcagcttctcttcctcctgtctactcgtcggcctccgagagactcagttgggaacgtaagtggtagactagacaactcgtcctccggtccacccgttgttctttacggttttccggagggggatacgacgcctacccgttcttccgtggttccggccgtaactagtcgaacggtacgggttacggttaaacgggaaccttaaacgttacggtccgttaagtactacgacgcgaagggaccggtccgtacggacctacggaccctaccgtaacgtaccttccctaacgttacttccggtttaccggacctttaaccccggtttaacggacgggttaccgtaaggtaaccggtaaccgttaaccccgaaggtacccgtaacggttacggaacggtccgggtacggttaacggtcgggttaaccgtacgggttaccttacgttaccgccttacgaccaactaacggttaaacaactaccgtanacgaaactcggtacgtaacgttctttagacgtttagtttactcgtagtcaagtcacgttacggagtaccgtagtccggctttacgtaccggttacgggaggtaacggaccgtagtaccggtaccaagtactagtgtccagcgtaacncggtacttcgtcgttacttacacccgttcaccgtcgngtaaccg

SEQ ID NO: 5490 - DNA, 887 bp, Homo sapiens
  misc_feature: GYAE6OF01DP7YC.8.28.C06.1.454.CMB.1.raw
  modified_base (159)..(159): a, c, t, g, unknown or other
  misc_feature (159)..(159): n is a, c, g, or t
  modified_base (200)..(200): a, c, t, g, unknown or other
  misc_feature (200)..(200): n is a, c, g, or t
  modified_base (877)..(877): a, c, t, g, unknown or other
  misc_feature (877)..(877): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtnatgacacagtcctccggtcacccttgttcttgtttttccgngggggatacgacgcccaccctctccgtggtcgaccggcctagtaccgagacggtcggttaacggaaccgtaaacgttcgccgttagggtactacgaaggtaccgaagggttaccggcccgtacgggacccgaacgggtcccgttaacccaaccggttaacccgttcccttaccgttaacgttttccggtttaccgggtacccgttaacccgttttaaaaccgggcccggggtaccgtaaccggttaacgggaaccttaccccgacgggtaccgtacgggtttacgaccgggtccggtggtacgggtttcggggtcgttaccgggggttacctttccgggtttaactacccgttccttaacccggaccgttaacttaaacccgtaaacgttaacccgtacgtaacgtaaccgttacgttaccggttaacgttaccgtttacggttacgttttaacgtttttacgtttacgttacggtactacggttaccgttaacgttacgttaacggtaccggttacgttccggttacccgttaccggttacgggttaccgggaacggggtaacgggtaaccgtaacgggttacccggtaccgtaacgtaaaaccggtcgtacgggttcgaccgttacgaccgttaacgtcgttcttcgttacctaccttaccgttcccttacccgnttcgtaccgg

SEQ ID NO: 5491 - DNA, 666 bp, Homo sapiens
  misc_feature: GYAE6OF01BZT91.8.28.C06.1.454.CMB.1.raw
  modified_base (146)..(146): a, c, t, g, unknown or other
  misc_feature (146)..(146): n is a, c, g, or t
  modified_base (238)..(238): a, c, t, g, unknown or other
  misc_feature (238)..(238): n is a, c, g, or t
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (452)..(452): a, c, t, g, unknown or other
  misc_feature (452)..(452): n is a, c, g, or t
tcagctcgcgtgtccacgaccggtgctcgatttagagctcacgtattgggtttgggggaggaactgctcagttacggacccagacggaaccatggaacgcccagcgcagcttctcttcctctgctactcgtggcctccagagactnagttggaagtaaggtggtagagtacgacaacgtcgtccgtcccggtccctacccttggttccgttttggtttttccgggagggagacggccnccctaccgttctccgtgtcggcggccagtgagtcggtacgttacggaacgtaactcggcgtagtcanagcgaggacggcncggcgacgccnccgactctcctattcgttcggtcggtcctacgtaacggcggacgaggtcgaacctcgaacctcggtagcgacggcgtgcggtgtcgggtntccgttntaccgcttacgctactaacataccanccgaatctatacgtatacgttacttgttatttcttgtcgtacgtagtgtacgtcgtaagtacgttcgttccgttcgttacggttacccggtacggggtacgggaaccgggtaagtaacgggtacctaaccgaaaccgtacggtaacgtacgggcgtacgaccgtataccttcgtaccgttcgtaaccttcttacccgttcctccctcgtctacg

SEQ ID NO: 5492 - DNA, 766 bp, Homo sapiens
  misc_feature: GYAE6OF01ERI3V.8.28.C06.1.454.CMB.1.raw
  modified_base (230)..(230): a, c, t, g, unknown or other
  misc_feature (230)..(230): n is a, c, g, or t
  modified_base (577)..(577): a, c, t, g, unknown or other
  misc_feature (577)..(577): n is a, c, g, or t
  modified_base (716)..(716): a, c, t, g, unknown or other
  misc_feature (716)..(716): n is a, c, g, or t
  modified_base (725)..(725): a, c, t, g, unknown or other
  misc_feature (725)..(725): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactcgtcggcctccagagatctagttggaagtaaggtggtagagtacgaccacgtacgtccgttcccggtacctacccgttgttccttttcggttttttaccggngggggaagacggtaccgacccctacccttccttccgttggtcggccggacctacgtacgaggtacgttaccgggttaacggaaccgttaacgttacgcgttaggtactacgagcgaggacggcctcggccgaggtcctaccgacgtacctcctactacgtttcgtttcggcctttaaccgttacggacggtaccgtaggtacgtaacctcccgagccgtaggtcgacggtcggacgtaggtcggttcgtacggttaccttcgttcaacgttcctacgactacgtacacgtaccagttccgaggtcgacgtaggtacgttagttgtacgtactttaaacggttttacncgtttacgaacctaacgttcggttaaccgtacggtacggttcccgggacccgggttacccgggtcgtttacccggttccggtacccgtacgggtaacctagtacggtactaccgaacgtaaacggcgttggcgtaccgnaccgacctnttcggttaccttccttactacccggttccctaccggtaccg

SEQ ID NO: 5493 - DNA, 739 bp, Homo sapiens
  misc_feature: GYAE6OF01CRI43.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (668)..(668): a, c, t, g, unknown or other
  misc_feature (668)..(668): n is a, c, g, or t
  modified_base (675)..(675): a, c, t, g, unknown or other
  misc_feature (675)..(675): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgngggganagagccaccctctcctgtgcggccagtcagacgtcggttaaggacctaacgttacgccttagggtactacaagcgaaggacgggacctcggcccgagggtcctaccccaacggacccttccctacgactttccgtttacggccgtacccgtttaaacggcggggtaccacggtagggaacctccccgaacgtcccgtaagggttcaacgggtcggccgtaggttcggggtacgtacggggtacctttcgggttactaccgttcgtaccaacctacgtacaaacgttaccctaggtacaacttcgtaggtaccgtactttcgtacttaacggtttttacttacgtcgttacgtacggtaccgttaggtcgttaaggaaacgtacggttcggttacccgtttaccgttacgggtttccggaccggggtacgggtaccgtaaacgggtcggtaccctaacgaaaccggngttacgngggtaccgtgaccgtaactcttaccgttcgtaccgttctaccttccccgtcctccttacgtacg

SEQ ID NO: 5494 - DNA, 709 bp, Homo sapiens
  misc_feature: GYAE6OF01E4FZC.8.28.C06.1.454.CMB.1.raw
  modified_base (439)..(439): a, c, t, g, unknown or other
  misc_feature (439)..(439): n is a, c, g, or t
  modified_base (463)..(463): a, c, t, g, unknown or other
  misc_feature (463)..(463): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacgagtcctccggtcaccctgtcttggtttttccgtggggagacgacgccctaccctctcctggtcgcggcagtcgagagtacgttaggacgtaacgttagccgtaggtactcgagcgaggacggtccgtggacccgacgggcctacccagacccttccgtactactttccgtttcggaccgttacctttaaacggcgggaccctaggtcgaacctcccgacggccgtaggtccacggccggcgtaggtcgggtcgtcgggtctttccggtacnctcaccacactacaaactaccgtntacaagtcgtacgtacgttacgttcgacttttaacgttttcttcgttgaccctaggtaccgtagttcgaaggtactaccggttacgggttcccgttacgtaccggttcggggaacgggtaccgggtaaccggtacgggttaccgtaaccgtaaccgtaacggtaccgttaggacggtacgtccgactaaccgttagttcccgttcgttacccgttacctcttccccgtcccgtctacggttacccg

SEQ ID NO: 5495 - DNA, 870 bp, Homo sapiens
  misc_feature: GYAE6OF01COPIN.8.28.C06.1.454.CMB.1.raw
  modified_base (200)..(200): a, c, t, g, unknown or other
  misc_feature (200)..(200): n is a, c, g, or t
tcagctcgcgtgtccacgaccggtgctcgatttagagctcacgtattggggtttggggggaggaactgctcagttaggacccagacggaaccatggaacgccccagcgcagcttctcttcctcctgctactctggctccagagatcattggagagtggtgatgacacagtctccggtcacctgtcttgttttcggggganagacgcctacctcgtccgtgtcgccgacagtcaggacggtacggttaacggaacgtaacgtttcggccgttgggtacacgaggaccgaaggccgggtccgtacgggacccgtacgggccctacccgaagtcccttcctactacgtttccggtttcgggaccttaccgtttaaacggcggggtacctaagggttcggtaaaccctcccgaagggtacccgtacgggttaccgaacggggtcggtcggtaacggggtttcgggggttaccgttacgggggtttaaccctttaccggtttcccgtaaccgttcccgtaacctaaaccttaacgttaacctaaaaccgttcccgtacgtaaccttaacgttcgtacggtaaccggtttacttttacgtacttttaacggttttacttacgtcgttaccaaggttaccgttacggttacgtaacggttaaccgtaccggtttccgggttacccgtttaaccggttaccgggttaccggggaacggggtaaccgggtacgggttaaacgggttacccggtaacgtaaccggtaaacggtacggttacggtccggccgtaaccggtaccctaaccggtttcgttcccgtttaccgttaccgttacccgttaacccttcccggttaccccgtacgttaccgtaccggg

SEQ ID NO: 5496 - DNA, 954 bp, Homo sapiens
  misc_feature: GYAE6OF01B4YQS.8.28.C06.1.454.CMB.1.raw
tcagctcgcgtgtccacgaccggtgctcgatttagagctcacgtattggggtttggggggaggaactgctcagttacggaccaggacggaaccatggaagcccagcgcagcttctcttcctcctgcctactcgtcggctccagagatcagttggagaagtggtgactgacacgtagtccgtccggtccacccgttgttcgtttcggtttttccgagggggtagacgtaccgccctacccctcgttccgttggcggccggtaccgtacgtcgaacggagttacggttaacggacgtaaacgttccggtacgtggtaactcgagacgtaacggccggaccgtacgggaccgtacgggacctacccgacgtacctcctacacgtttccgtttacggggacccgttaaccgtttaacggacgggaccgtaaacggttacggaacccgttcccgaggtaccccgggtaaggttaccgtagggacccggttaggtacgggttacggggtaccgtttccggggttacgtttaccgggttaccctaacgttacccttaccctaaccgtaaccttaaataaaccccgttaaccgtaacgggtaacctaaccgttcggttaaccgttaaccgttacgttttacgaacggttttaactttacgttttcggaacgttcccgtaaggttacgtacgttaacgggttaaccgaacggttacccggtttaccgggttaccgtttaacccgggttaaccgggggttttcccggggaaccgggggttttaacccggggaaaccgggtttaaaccgggggtaaccgttaaacccgggtaaaacgtaaaccgggttaacccgttaaggttacccgggtaaccgttacgaccccgttaacccggttacggtttacgttacgggtttacccttcgttaaccgttacccctttccggaaacctttagtaccccggg

SEQ ID NO: 5497 - DNA, 759 bp, Homo sapiens
  misc_feature: GYAE6OF01EJ6CW.8.28.C06.1.454.CMB.1.raw
  modified_base (483)..(483): a, c, t, g, unknown or other
  misc_feature (483)..(483): n is a, c, g, or t
  modified_base (563)..(563): a, c, t, g, unknown or other
  misc_feature (563)..(563): n is a, c, g, or t
  modified_base (724)..(724): a, c, t, g, unknown or other
  misc_feature (724)..(724): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtcctccggtccaccctgttcttcgttttttccgtgggggtacgaggacgccccgtacccttcttcccgttggtcggcccgggccgaagttccgaggtacggttaccggttacgggtaaccggtaaaaccgtttacggtaccccgttagggttaaccttccgtaacgaccgaacggtacgggcccgttacgggaccccgacggtcccgtccccgaaaggtcccttacccctactaacgtttccgtttcgggtcccgttacccgtttaacggaccgggtccaaggttaccggaacctacccgtaggttcgtaacggnttacggaaggccggtcgagggtcgtcggtcggtacgtttcgtacactcgtccacgtacttacaactaacgtcacgacttntacgaacgtttcgttatacgttagtttcttacgtcgtagtactataccgttgcgtaacgttcttcgggtaccggttcttaacggttcgggtaacgggaccgggtaacgtaagggtaccgaccgttaacgaaaccgttacgtacggtcggcctaggcctacncgttatcgtaccttacgacttccgtacccgactcg

SEQ ID NO: 5498 - DNA, 870 bp, Homo sapiens
  misc_feature: GYAE6OF01CEAUF.8.28.C06.1.454.CMB.1.raw
  modified_base (169)..(169): a, c, t, g, unknown or other
  misc_feature (169)..(169): n is a, c, g, or t
  modified_base (217)..(217): a, c, t, g, unknown or other
  misc_feature (217)..(217): n is a, c, g, or t
  modified_base (468)..(468): a, c, t, g, unknown or other
  misc_feature (468)..(468): n is a, c, g, or t
  modified_base (857)..(857): a, c, t, g, unknown or other
  misc_feature (857)..(857): n is a, c, g, or t
tcagctcgcgtgtccacgaccggtgctcgatttagagctcacgtattggggtttgggggaggaactgctcagttaggacccagacggaaccatggaagcccagcgcagcttctcttcctcctgctactctggctccagagactcagttggagaaggtggtgatgacacngtccgtccggtctacccgttgttcgtttaggtttttccggaggggganacgtacgcccacccttcgtacccgttggtccggcggacctaggttaccgaggtacggtaccggttaacgggaccgtaaacgttcggaccgttagggtaactacgacggcgaacggcgggtacccgtggggacccgtacgggtccccttacccgacgtaccttcccttacgacgtttcggtttacggcccggttacgtttaaaccgggacgggtccgtaggtacgaacctccccgagcccggttacggtacncgggtcggtacggtacgggttcggggtctttacggggttacccgtttaccgtccgtaacgtacccgttcccgaaaaccttacgttaaccaaacccgtttcggtaacctacgtaaccgtttcgtaaaccggtacggtttacctttaggttacctttaagtttttccgttagacggttacgtaacggtcgttacgttacggtaaccgtaaccggttaccggttacggttcccggtttaaccgtttaccgggttacccggggaccgggggttaaccgggtaaaccggacggggtttaccgaacccttaacgggaaccgtgttaccgggtcgtacgttaccgacttaccgttcgttcgtttacctaccggttccacccggtttcctacccgtnttaaacggtcccg

SEQ ID NO: 5499 - DNA, 812 bp, Homo sapiens
  misc_feature: GYAE6OF01BHBM1.8.28.C06.1.454.CMB.1.raw
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (301)..(301): a, c, t, g, unknown or other
  misc_feature (301)..(301): n is a, c, g, or t
  modified_base (780)..(780): a, c, t, g, unknown or other
  misc_feature (780)..(780): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcagttggagaaggtggtagatcgaaccacgagttccgtccggtacctacccgttgttcgtttcggtttttccgnggggganacggacgcccctacccttctccgtgtcggcgcctagtcgaggcggtacggttaaggaactacgttgccgttgtacncgacgtacgaggacggccgtcggacccgacggtccctaccgacgacccgttcctacgtactttcggtttacgggtcccttaacccgtttaacggacggtaccgtaagggtacgtaaccgtccccgagtaccgtaggtacgaccggcggtacgtacgggttcgggtcgttacgggtaacgtttccgtacctacctcctacgtacctactaacaaaccgtaccagtacctagtaccgttacgtaaccgttcgtttactacgtttacgttttcgttaccgtagttaccgtacggtacttaggtaaccgttaaggtaacgttacccgggttcggttacccggttttacgtacccgggttacgggggaccgggtaaaccgggttaccgggtaaaggtccccgggtaaactacccgggtaaaacgtacggtcggtaccgtacgtccgaacgtaccttcggtacccgtttcgtcccgtttaacccncccttacccggttaccctcgtaacgtacccgg

SEQ ID NO: 5500 - DNA, 741 bp, Homo sapiens
  misc_feature: GYAE6OF01CTPYN.8.28.C06.1.454.CMB.1.raw
  modified_base (240)..(240): a, c, t, g, unknown or other
  misc_feature (240)..(240): n is a, c, g, or t
  modified_base (272)..(272): a, c, t, g, unknown or other
  misc_feature (272)..(272): n is a, c, g, or t
  modified_base (728)..(728): a, c, t, g, unknown or other
  misc_feature (728)..(728): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggaagaagtggtgatgacacagtctccggtcacccgtgtcttcgtttttccgtggggagagacgcctaccgtctcctggtcgcggccagtcagnggtacgtacggacgtaacgttacgctaggtancagaccgaggacggctggccacggcctccaggacctccgtatacgttcgttcggccgtaccgtttaacggacggaccgtaggtacggaaacctcccgaacggtcgtacggtaccacggaccggtcgtaggggtcgggttcgttacggggtaccttttcggtacctaacgttcccgtaactaccctaagtaacctaacttaccgtacgacttaacgtctacgtacgttacgttcgtacttacgtttacttttcgacgttcaaggtctacggtacgttacggaacgttccggttacgtcccgtttggttaccggttccgggaacggggtaccggtaacggttacgggtaaccgtaccgaaaccgtaaaccggttacgtggttaccgggacgtacgttacaacccggttactttaccgttccggttaccctacgttttaccccacccgtttcccccggnttacccggtaacg

SEQ ID NO: 5501 - DNA, 816 bp, Homo sapiens
  misc_feature: GYAE6OF01BVBU3.8.28.C06.1.454.CMB.1.raw
  modified_base (206)..(206): a, c, t, g, unknown or other
  misc_feature (206)..(206): n is a, c, g, or t
  modified_base (277)..(277): a, c, t, g, unknown or other
  misc_feature (277)..(277): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaaggtggtagatgacacgagtccgtccggtccaccctgttctttgtttttccgngggagagacgcccaccctctcgtgtgccgcagtcgagacgtcggttaacggacgtaacgtacgctaggtancgagcgaaggcggtcctcgggcccgacggtccctacccgtaagtcccgttacccctctacgtttccggtttcgggacccgtttaaccgtttaaaccggacggggtacccgttaaggtacgggtaaaccctaccccggtaacggtaccccgttacggttaccgacgggtcccgggaggttaacgggttcgggggttaccgttacggggttacccttttccggtttacccaaccgtttcccgtacctaaacccgtaaccttaacgtaaaaccttaacccgtacgtaactaacgttccgtaacggtaccgttacgtttagtacctttagttttctttcgtcgtaaccgtgtacgtaagttcgtaacggacgtacggttcggtacccttcggttaccggttaccggggacgggttaacggaccgtaggggtaccgtaacctaacggaaccgtacggttaggtccggtcgtaccgtaccgacttacgttcgttaacccggtttacttcccgttacccttaccccgtcccgtcgtcgtaacccgg

SEQ ID NO: 5502 - DNA, 785 bp, Homo sapiens
  misc_feature: GYAE6OF01BNB6U.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (265)..(265): a, c, t, g, unknown or other
  misc_feature (265)..(265): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccaccctctcctgtcgccggcagtcagagtcgttaggacgtaacttagcctggtancgagcaaggacggcctggccgaggccctacccagtaccttcctctacgtttcgtttcgggcccgttacccgttttaaacggacggggtacctaagggttacgggtaaaccctcccccgaacggtacccgttaaggggtttccaacggggcccggacggtaacgggttcgggggttaccgttacgggggttaaccttttccggttacctacctttcctacccaacccgtaattaccaaaacttaacccgtgtaacctaaagttccgtacggtaaccgtttacgtttgtaccgtttaagtttttacttccgtgtaccgtagtacctagttacgtaacggaacggtccggttccgggttacccggtttccgttaaccgggtttcgggacccggggtaaacgggtaaccggtaacgggttcccgaaaccgtaaccaaaaccggttagttcggtacggtccgtagtaccaccgttagtccgttacgttccgtacctaccgttccccgtacccgtccagttaccgg

SEQ ID NO: 5503 - DNA, 764 bp, Homo sapiens
  misc_feature: GYAE6OF01BPYVY.8.28.C06.1.454.CMB.1.raw
tcagctcgcgtgtccacgaccggtgctcgattttagagctcacgtattgggtttggggaggaactgctcagttaggacccagacggaaccatggaagccccagcgcagcttctcttcctcctgctactcgtggcctccagagatcatggagaagtggtgatgacactagtccgtccggtcctacccgttgttcctttcggtttttccggaggggtacgagaccgaccctacccttctccgtggtcgccggccgtacgtcgaggtacgtacggttaacggaaccgtaacgttacgccgttaggtactacgagcgtaaggcggtccgtacggccgtacggcctacccgagtacctcctacttacgtttccggttcggtcccgttaaccgtttaacggccgggtaccgtaacggtacggaacccttccgaacggtccgttaggtaccgacggtcggtacggtagggttcgggttacgtcggttacctttcgtaccgtcttaccactacctactaacctaacgtactacgaacgttacctcgtacgtacgttccgtttagttactttacgtttcttacgtcggttactacgtcgtacggttacgtaacgtacggttccgggtacgtttccggtacgtttaccggggtaccgggacgggttaacggtcggtaaacggtccgaaccgtaacgtacggtacgttcggaccgtcgtacgtcccttactcgttcgttcgttcctaccgttaccgtccctccggattccggccg

SEQ ID NO: 5504 - DNA, 759 bp, Homo sapiens
  misc_feature: GYAE6OF01CL0Y8.8.28.C06.1.454.CMB.1.raw
  modified_base (209)..(209): a, c, t, g, unknown or other
  misc_feature (209)..(209): n is a, c, g, or t
  modified_base (405)..(405): a, c, t, g, unknown or other
  misc_feature (405)..(405): n is a, c, g, or t
  modified_base (432)..(432): a, c, t, g, unknown or other
  misc_feature (432)..(432): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctccagagatcattggagaagtggtgatgacagagttccgtccggtccaccctgttccgtttcgttttttccggnggggacgacgacgccctaccctctccgtgtcgcgccagtacgaggagtacgtacggacgtaaccttgcctggtactagacgacgaggaccggtcctacgggcccgaacggcccttacccgacgtaccttcccgtactaccgtttcgtttccggaccgttaccgtttaacggacggggttacccaggtacgtaaccnccgacgtccgtacgttcgacggtccgngttacggtggttcgtaggggtaccctttcggtacctcgtctaaccgacctaagtactaaccgttaaaccgtcaactacgtcgtaacggtacttaccgtttggaacctttgttttacttcgttacgcgtacgtacgttagtcgttaacgacggtttaccggaccgttccggtttaccgtaccgggtttccggaaccggggtacggttaaccggtacgggttaaccgtaccaaaccggtaaccggtacgttcggaccgtacgtccgacccttacggtacttccgttacgttcgttaacctcccgttcccgtaacccgtctaaggtaccg

SEQ ID NO: 5505 - DNA, 859 bp, Homo sapiens
  misc_feature: GYAE6OF01B07CZ.8.28.C06.1.454.CMB.1.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactcgtggcctcccagagattcattggagaaggtggtgatgacacagtcctccggtcaccctgttcttgtttttccggngggganacgaccgcctaccctctccgtggtcggcggtacacgtcgaggagtacgtaacggaacgtaacttacggccgtggttacacgacgcgtaagcgggtccctagggacccaggtccctacccgaagaccttcccgtacactttcggtttaccggaccttaaccgtttaaacgggccgggtactaggtacgaacctcccgagtccggtaggtcacggtcggcggttaggtcggggtctacgggtactttccgctacttcgccactaacgtacctaaaactaccgcgtaacgtacgttaccgtacggtaacttcggtttacctacggttttaagtttccttttacggtacgttacccggtgttaaaccgtccggtttaaccggaaggtttaaacgggttcccgtaccgggtttacccgggtttaccggtttaaaccccggggttcggggggtaaccggggaaacccggggttaaccgggtaaccgggttaaacccggttaccgggtaaacccgttaaaacccgggtcgggttaccggggttaacgtacccgggttccggtaaaaccccgttccggtacgtttcccggttacgttttacccgttccttaccccggggttaccccctttacccgtaaccttacccgggtaaccgg

SEQ ID NO: 5506 - DNA, 809 bp, Homo sapiens
  misc_feature: GYAE6OF01BEF0H.8.28.C06.1.454.CMB.1.raw
  modified_base (200)..(200): a, c, t, g, unknown or other
  misc_feature (200)..(200): n is a, c, g, or t
tcagctcgcgtgtccacgaccggtgctcgatttagagctcacgtattggggtttggggggaggaactgctcagttaggacccagacggaaccatggaagccccagcgcagcttctcttcctcctgctactctggctcccagagatcagttggagaagtggtgatgacacagtctccggtcaccctgtcttgtttttccgnggggagagacgccaccctctctgtggcgccagtcagagtacgttaggaccgtatacgctgtatcagcaggagccgtggccacggcctcccaagcccgtcctcctagttcggtttacgggacctacctttaacggacgggacacggtaggaacctcccgacgtccgtacggttaccgaggcgggaccgtagggttcgggtacgtcggggtactttaccggttaccaacctttcctacaaccctaacgtttaaccctaagttaaacccgtacgttaactaaccgtttacctacggttaaccggtttaccgtttacgtacgtttttaaagttttacctttaccgtttacgaccttaaacggttaccgttaacgtttacgtaacggttaaacggttaccccgggttagggttccccgtttacgtttaaccggggtttcccgggtaacggggtaacccggggttaacggtaaccgggtacccggtaaaccggttaaccgtaaaccggttaacgttaccggtaacgggtccctcgggtaaccctaccggttaccttccgtttacgttaccctttccctaaccgtttccccggttccccgtccgtacttaaccggg

SEQ ID NO: 5507 - DNA, 883 bp, Homo sapiens
  misc_feature: GYAE6OF01AQ6HI.8.28.C06.1.454.CMB.1.raw
  modified_base (215)..(215): a, c, t, g, unknown or other
  misc_feature (215)..(215): n is a, c, g, or t
tcagctcgcgtgtccacgaccggtgctcgatttagagctcacgtattggggtttgggggagaactgctcagttaggacccagacggaaccatggaacgccccagcgcagcttctcttcctcctgctactctggcctccagacgatcagttggagtaggtgtgatgacacgtacgtccgtccggtcctacccttgttccgtttcggtttttccggngggggacgacgaccgcccctaccgtccgttccgtcggtccggaccgccgagtacgaggacggttacggttaaccggaacgtacgttacggccgttaggtactaccgaaggccgaacgggtccggccgtaccggggtacccgacgggtaccctacccgtaacggtccccttaccctagtttacccgtttccggggtttaccggtaccccggtttaacccgttaaaccgggccggggtacccgttaagggttacccggtaaccccgttaccccgtaaacggttcccggtaacgggttccgaacggggccggttaccggtagggttccggggtttaccgttacggggtttcccttaccggttacctaacccgtttcctaacccgaaaccttaaccgttaaccgtaaccgttaaccgtacgtaactacgttaccgtaacggtaccgtttaccttagtaccgtttagttttctcgttagtacctaggtacgttacgtagtacggtaccttccggttaccgttaccgttccggtaaccggttaccggggaccggttaacggaccggttaagggtacccgtaactaaacgtaccggtcggttcgtacggcccgttaacgtcaacccgttgttctaacccgttcgttacccacgtttacccctctcgacgttaccg

SEQ ID NO: 5508 - DNA, 758 bp, Homo sapiens
  misc_feature: GYAE6OF01D8TT2.8.28.C06.1.454.CMB.1.raw
  modified_base (221)..(221): a, c, t, g, unknown or other
  misc_feature (221)..(221): n is a, c, g, or t
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
  modified_base (519)..(519): a, c, t, g, unknown or other
  misc_feature (519)..(519): n is a, c, g, or t
  modified_base (539)..(539): a, c, t, g, unknown or other
  misc_feature (539)..(539): n is a, c, g, or t
  modified_base (568)..(568): a, c, t, g, unknown or other
  misc_feature (568)..(568): n is a, c, g, or t
  modified_base (573)..(573): a, c, t, g, unknown or other
  misc_feature (573)..(573): n is a, c, g, or t
tcagctcgcgtgtccacgaccggtgctcgatttagagctcacgtattggggtttgggggaggaactgctcagttaggacccagacggaaccatggaacgccccagcgcagcttctcttcctcctgactactcgtggcctacccagagatcagttggagtaagtggtgatgactacacgtcctccggtcacccttgttcttttcggtttttccgaggggganagaccgtacccctacccttcgtccgttgacggccggacctacggtcacggaggtaccgttaacgggaactaaacttcgacgttggtactcgagcgaaggcggtccgtcggcccgacggtcctacccgagtaccctccttntacgttcggtttcgaccgtttaccgttaagcggggtacctaggtccggtaaccncctacggacccgtaggttccgacggcggtaccggtaggttcggggttaccggtacgggttactttccgtactccgacctaccgtacctactaacgtaaactcgngaactactacctgtaacgtntttcgtattcgtttaattccgtatcgacncgttntacgacgtctacgggtacttcgttacgtcggttaccggacggggtaaccgtaacgggaccggtacggtacccttaaaaggaccgttaaggttccggagttacccgtacggtaacccttacgtacgtttcccgtaccgttttcgttacgtaccccctttaccgtacccccgttgtacgttacccgg

SEQ ID NO: 5509 - DNA, 822 bp, Homo sapiens
  misc_feature: GYAE6OF01EY6DQ.8.28.C06.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
tcagctcgcgtgtccacgaccggtgctcgatttagagctcacgtattgggtttgggggaggaactgctcagttaggacccagacggaaccatggaacgccccagcgcagcttctcttcctcctgctactctggcctccagagatcattggagaagtggtgatgacacagtctccggtcacctgtctgttttcngggganagacgccacctctcctgtgccggccagtcaggagtcggttaaggacgtaacttaggccttggtatcgagcgaggacggcctggccaggcctacccgagacctcctctacgttccgtttacgggccttacccgtttaacggacggggtccctaagggttcggtaaaccttccccgaacggtcccgtaagggttccaacgggccgggtaccgtaagggtttcgggggtacgttacgggggtaaccttttaccgggttcctaaccgttcgtacctaaacccgattaaccaaaacttaacccgtagtacctaacgttcgttacgtacgttaacgtttgacctttaaggttttacgttttaccgttcggttaccgtaggtaccttaacggtttaccgtaacggtaaacgttacccggttcgggtaaccccgttttacggtaaaccggttttcccgggggaccggggtaacgggtaacccggttaaacggggttacggtaacccggttaaccgaaaaccgggtaaccgttcgggtaccgggtaccgttccgggtaaccctacccgtacgttcgttacgttacccttaaccggtactttacccccggttacccgtacgtacgttacccgg

SEQ ID NO: 5510 - DNA, 827 bp, Homo sapiens
  misc_feature: GYAE6OF01ARP47.8.28.C06.1.454.CMB.1.raw
  modified_base (209)..(209): a, c, t, g, unknown or other
  misc_feature (209)..(209): n is a, c, g, or t
  modified_base (283)..(283): a, c, t, g, unknown or other
  misc_feature (283)..(283): n is a, c, g, or t
tcagctcgcgtgtccacgaccggtgctcgatttagagctcacgtattggggtttggggggaggaactgctcagttaggacccagacggaaccatggaagccccagcgcagcttctcttcctcctgctactctggcctcccagagatcagttggagaaggtggtgagtgacacagttctcccggtcaccctgttccgtttgtttttccgngggggagacgaccgcccaccctctcctggtggccgcagtcgagacgtcgttaggaacacttaggccgtaggtancagagacgacggtccgtacggcctaccggcctacccgaacgtccccttcctataccgtttccggttttaccgggaccccgtttaccgtttaaaccggacggggtaccccgttaagggtaccggaaccccgttccccacgggaacccgttacggttacgacgggttccggcggtagggttcggggttcggtaggggttaccctttcgttactcctccgttaacacccgtactaacgaaaccttactcgtactacgttcgtacgtaacggttctttacgtacgttttagtttctttacgtacgtaccgtacgtaccgtagtttcggtaagtaccgtacgggttacccgggtttaccgtttaccggttacccgggtttaccggggtacggggtaacccgggtaaccgggtaacgggttacccggtaacccggtaaaccggaaaccggttaccggttacggtaccgttacgtaccgtaccctacgttacgtttccgttaacgtttccttacccgtactttaccccgtacccgtccgttacgttaacgg

SEQ ID NO: 5511 - DNA, 721 bp, Homo sapiens
  misc_feature: GYAE6OF01DW2D5.8.28.C06.1.454.CMB.1.raw
  modified_base (193)..(193): a, c, t, g, unknown or other
  misc_feature (193)..(193): n is a, c, g, or t
  modified_base (302)..(302): a, c, t, g, unknown or other
  misc_feature (302)..(302): n is a, c, g, or t
  modified_base (711)..(711): a, c, t, g, unknown or other
  misc_feature (711)..(711): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccgtcacctgtcttgttttcgngggagagacgcctacctctcctgtcgcgcagtcagagtcgtaggaacgtaacttcgccgtaggtatcgagcgaaggacgcgtcggaccacggcctaccacgacttcccncgtacgttcgtttacggccgttaccgtttaacggacgggtaccaaggtacgtaacctcccgtaacggccgtacggttacgcggtacggtacgtagggtcggtacggtacgggtacctttcggttacctactcctaacctacgtaacgttaacctaaaacgttaacccgttacgaccttaacgttaccgttacggtaaccttacgtttacgtaactttacgttttaacttcgtacgtacgtgtactacgtcgtaacgtacggtaccggtcgttccgttacgttaccggttacgggacggtaccgggaacggttacgtcggtaacccgtaacgtaaaccggtcgtacggtacgtccgtagtacccacttacgttccgttacgttacttccgtacccttcccgtacccggtntcgtaaccgg

SEQ ID NO: 5512 - DNA, 804 bp, Homo sapiens
  misc_feature: GYAE6OF01DVL8X.8.28.C06.1.454.CMB.1.raw
  modified_base (134)..(134): a, c, t, g, unknown or other
  misc_feature (134)..(134): n is a, c, g, or t
  modified_base (147)..(147): a, c, t, g, unknown or other
  misc_feature (147)..(147): n is a, c, g, or t
  modified_base (225)..(225): a, c, t, g, unknown or other
  misc_feature (225)..(225): n is a, c, g, or t
  modified_base (708)..(708): a, c, t, g, unknown or other
  misc_feature (708)..(708): n is a, c, g, or t
  modified_base (753)..(753): a, c, t, g, unknown or other
  misc_feature (753)..(753): n is a, c, g, or t
tcagctcgcgtgtccacgaccggtgctcgatttagagctcacgtattgggtttgggggaggaactgctcagttaggacccagacggaaccagtggaacgccccagcgcagccttctcttcctcctgctactcgnggcctcccagagntcgagttaggagtaaggttgagatcgaacacgtagtccgtccggtcctacccgttgttctttggttttcggagggganaacgcgccccgtacctccgtacgtggtcggccgaccgtagtcgagtcgtacggtacgacgttaacgtcgcgtaggtactacgagacgaggccggaccgtcgggacccgtacccggaccccggtatacccgttccgtacttaccggtttacggttccgtaccggttaaaccggtttacgaaccgggtccggtaaagggttccggaacgtacccacggtacggtacggttaccggaggtccgggaggttccgggttagggttaccgtcgggttaccgttacgttctaccggtaactccgtaacctaagaaccttaacgttaacccgagtactacgttacgtacgttaaccggttacctttgtaaacccgtttttattccgttttaatcccgtagttaacccaggttacaacggttccaacggtttccgtaacgttccggtaacgttcccgggtaagggtaccggaacgggtacgtaacccgggtntaaccggtaaacggacctggtgtaccgtcacgggtacccacgttnttacggttcttaccctcgttaacctccgttacccgtcttacgcggttaccg

SEQ ID NO: 5513 - DNA, 790 bp, Homo sapiens
  misc_feature: GYAE6OF01BWAMP.8.28.C06.1.454.CMB.1.raw
  modified_base (204)..(204): a, c, t, g, unknown or other
  misc_feature (204)..(204): n is a, c, g, or t
  modified_base (531)..(531): a, c, t, g, unknown or other
  misc_feature (531)..(531): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtccgtccggtccacctgttctttcggtttttccggnggggagagcgccctaccctctcctgtcgccgcctagtcgagtcgtacggttaacggaacgtaacgttacgccgtggtactcgagacgaggaccggcccgtagggacccgacggtccctacccgacggtacccttcctacgtactttccggtttcgggaccctttaaccccggtttaaggaccggtccgtaagggttacggtaacccctacccgaccgggtaccgttagggtccgaaggcccgggtacggtacgggttcgggggttccggtacgggtttacccgtttccgtacgtacctcctaacctacctactaactaaccgtaacnccgtatacttcgtacggtaccgttacgtttacgtacttttaacgtttcgtttacgtcgttacgtaacgtcgtaaccgtgtacgaacgttacgttcccgggttaccgtttcggtaccgggtttcggggacgggtaaccggtacgggttaacggtaccggtaacccgtaacggaacggtaacggtcgggtacgtccgtaccgtacctacgtccgttacgttccgttaccgttctacccttcccttaccggtctcgttacgg

SEQ ID NO: 5514 - DNA, 902 bp, Homo sapiens
  misc_feature: GYAE6OF01B6DTP.8.28.C06.1.454.CMB.1.raw
  modified_base (159)..(159): a, c, t, g, unknown or other
  misc_feature (159)..(159): n is a, c, g, or t
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcagttggagaagtggtnatgacacagtctccggtcacctgtcttgttttccgnggggagacgacgccctaccgtctccgtggtcgcgccagtcagagtacgttacggaacgtaacgttacgcgtaggtatcgagacgaggacgggtccgtacgggccaacgggtaccctaccccggtaacgtacccttccccttaactacggttttaccgttttaccggggtaccccggtttaacccgttttaaaaccggggaccggggtaccccggtaaaggggttaaccgggtaaaccccgtaacccccggttaacggtacccccgggtaaagggtttacccggaaacggggttcccgggaccggggttaggggtttaccggggggttacccgggtttacggggggttacccttttaccggtttaccccgtaaccttacccgtaacccgtaaacccttaaccgttaaaccgtaaaacccgttaaaccgttacggtaaccttaaacgttccgttaacgggttaaccgtttacgttttacggtaacttttaacgtttttacgttctacggttactacggtacgttacgtacgtaggtaacctacggttccggttacgtttccgtacgggttaccggggaaccgggtacgggtaaacgttacgggtaccggtaacccgtaacgtaaccggtacgtgggacgtcgaaccgtaccgtaaccgtcgttcgtacgtttcttaaccgttcctaccccggttcctcgtacctacggg

SEQ ID NO: 5515 - DNA, 862 bp, Homo sapiens
  misc_feature: GYAE6OF01A7KUQ.8.28.C06.1.454.CMB.1.raw
tcagctcgcgtgtccacgaccggtgctcgatttagagctcacgtattggggtttggggggaggaactgctcagttaggacccagacggaaccatggaacgccccagccgcagccttctcttcctcctgcctactctggcctcccaggagatctagttgggaagaaggtggtgatagacacagtccgtccggtcctaccgttgttcgtttcggttttccggtaggggagacgaccgtcccacccttcctccgtggtcggaccggaccgacggtacgacggtacgtaccgggttaacgggtaaaccgtacgttacgtaccggttaggtactccggagtcgaacggggtcggtcccgtcggcctacgggtaccctcccgacgtaccctcctacgtccgtttacgttccggtaccgttaccgttaaaccgcgggtaccgtaggacggtaacctccgtacgccgtaacggttacgacgggcggtacggtagggtcggttcggttacggggttacctttcggtacctaaccttcgtaacctacgtaactaaccgtaactaccgtagttacctaacgtctaccgtacgtttacgtttacgttaacgtttacgttttcttaccggttacgtaccgtaacgtccgtacttaaccggtaagggtaacttacccgggttacgttacccgggttaccgttaccggggttaccggggaacggggtaaccggggtaaccgggttaacgggtaaccgttacccgaaaccgggtaacgttaaccggtcggtaccgtaccgcgttacccgacgttacgttcccggttattaccccgttacctttacccgttacccgttaccctacgtaccggttaccgg

SEQ ID NO: 5516 - DNA, 880 bp, Homo sapiens
  misc_feature: GYAE6OF01D8G4E.8.28.C06.1.454.CMB.1.raw
tcagctcgcgtgtccacgaccggtgctcgatttagagctcacgtattggggtttgggggaggaactgctcagtaggacccagacggaaccatggaagccccagcgcagcttctcttcctcctgctactcgtggcctccagagatcattggagagtggtgatgacacagtcctccggtccacccttgttcgtttacggtttttccggaggggtacgagaccgccctacccgtctcctggtcgccggcctagtcgaagtacggacggttacggaacgtaacttcgtcgtaggtatcgagtcgaaggcgtcgtcggccgacggaccctaccgacgtacccttccgtaccttacgtttccggtttacgggtaccgtttaacccgttttaaacgggacggggtacccgtaagggttaccggtaaaccttcccccgaacggtaccccggttagggtttaccgacggggtacccggtacggtaacggggtttcgggtacccggtttacggggtaacccctttttcgtacccttaacccgttccgtacccctaaacgtaaccgtttaaactaacctaaccgtacgtaactaaccgttacgtaacgttaccgttacgtttacgttaaacccgttttaggtttacctttacgacggtttcaacgttcgtacggtttacgagtacggtttaccggttcgttaccgtcgttaaccgggttcgggaccggggttaacgggtacccgtacggggttaccgtaaccccgtaaacggtaacgtaacgggtcgggtttacgaccgggtaacctacccggaaacggtttccttaaccgggttccttaacccgtttccgtaacccgttccccgttaccccgtcgttccgttaacccggg

SEQ ID NO: 5517 - DNA, 515 bp, Homo sapiens
  misc_feature: GYAE6OF02FWPK7.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagctggccgtttcactttcggcggagggaccaagggtgacctcgaaacgactgtggctgcaccatctgtcttcactccttccgcctatc

SEQ ID NO: 5518 - DNA, 517 bp, Homo sapiens
  misc_feature: GYAE6OF02F9GXK.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctagacgactttgctagtttatttctgtcagcagttctgaagactggccgttcacgtttcggcggagggaccgaaggtcgacctcgaaacgactgtggctgcaccatctgtcttcatcctcccgcatcg

SEQ ID NO: 5519 - DNA, 521 bp, Homo sapiens
  misc_feature: GYAE6OF02GMKIC.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcggttcactctcaccatcaataacctgcaatctgacgactttgctagtttattctgtcagcagtctgaagactggccgttcacgttttcgggcggtagggaccaagggtcgacctacgaaacgactgtggctgcaccgatctgtcttcattcctcccgcatcg

SEQ ID NO: 5520 - DNA, 525 bp, Homo sapiens
  misc_feature: GYAE6OF02I18NG.8.28.C06.1.454.CMB.1.raw
  modified_base (310)..(310): a, c, t, g, unknown or other
  misc_feature (310)..(310): n is a, c, g, or t
  modified_base (504)..(504): a, c, t, g, unknown or other
  misc_feature (504)..(504): n is a, c, g, or t
  modified_base (512)..(512): a, c, t, g, unknown or other
  misc_feature (512)..(512): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccagtggaatcccagccaggttcagcggcagtggtctgggacttcgttcactctcaccatcaataacctgacaatctgtacgactttgctagtttatttctgtcagcagttctagaacgtactggccgtatcctacgtttcgggcgggtagggaccaagggtcgaacctacgaaacgactgtggctgcacntctgtctnctcttcccgctac

SEQ ID NO: 5521 - DNA, 520 bp, Homo sapiens
  misc_feature: GYAE6OF02JCDOQ.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcggttcactctcaccatcaataacctgcaatctgacgactttgctagtttatttctgtcagtcagtctgaagactggccgttcacgtttcggcggagggaccaagggtcggacctcgaacgactgtggctgcaccatctgtcttcactccttcccgccatcg

SEQ ID NO: 5522 - DNA, 538 bp, Homo sapiens
  misc_feature: GYAE6OF02IWLFC.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacgagggccagtggaatcccagccaggtcagcggcagtgggtctgggcttcgtcactctcacatcaatacctgcatctgacgtactttgctagtttattctgtctagcagttctagaagtcgtggtccgttctacgtttcgggcggtagggaccgtaagggtcggaacctacgaaacgacgtgtcggcgtcgaccaccatcgtgttcttcacttccgttcccgcctatcg

SEQ ID NO: 5523 - DNA, 532 bp, Homo sapiens
  misc_feature: GYAE6OF02FQ8F8.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacaggccagtggaatcccagccaggttcagcggcagtgggtctgggacttcgtcactctcaccatcaatacctgcaatctgacgactttgctagtttatttctgtcagcagtctgaagtactggccgttcacttttcgggcggtagggacctaagggtcggacccgtacgaaacgtacgtgtcggcgtgccaccatctgtcttctacttccttcccgcctatccg

SEQ ID NO: 5524 - DNA, 518 bp, Homo sapiens
  misc_feature: GYAE6OF02H9WMN.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaatcccagccaggttcagcggcagtgggtctgggacttcgttcactctcaccatcaataacctgacaatctgacgtactttgctagtttattctgtcagcagtctgaagactcggtcgttctacgtttcggcggagggaccaaggtcggacctcgaaacgactgtggctgcaccatctgtctcatccttcccgcatcg

SEQ ID NO: 5525 - DNA, 552 bp, Homo sapiens
  misc_feature: GYAE6OF02J0BLD.8.28.C06.1.454.CMB.1.raw
  modified_base (309)..(309): a, c, t, g, unknown or other
  misc_feature (309)..(309): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcttggctcctttaacngggccagtggaactcccagccaggttcagcggcagtggtctgggacttcattcactctcacatcaatacctgacaatctagacgtactttgctagtttattctgtcagctagtctgtaatcgtggtcccgttactacgtttccgggacggtaacgggaccgtaagggtcggaacctacgaaaccgtacgtggtcggcctgaccacctagtcttacgtcttactattcccgttcccgacctacg

SEQ ID NO: 5526 - DNA, 508 bp, Homo sapiens
  misc_feature: GYAE6OF02HKED6.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcgcagtgggtctgggacttcgtcactctcaccatcaatacctgcaatctgacgactttgcagtttattctgtcagcagtctagaagactggccgttcactttcggcggtagggaccaaggtcggacctcgaaacgacgtgtgcgtgcacatctgtcttcatctcccgcatc

SEQ ID NO: 5527 - DNA, 637 bp, Homo sapiens
  misc_feature: GYAE6OF02JBY7M.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggctcccagactcctcatctttggcgtcctttaacgagggccaggtggaactcccacgccaggttcaggcggcagtgggtctgggacttcgtcactctcacatacaactaacctgacatactcgacgtacttcgtactagtttatttcttcgtctacgtactacgtactagtaacgtacgtcggtccgttcgtaccgtttccgggtaccgggtaacgggtaaccggtaacgggtacgggtacccgtaaccgtaaaccgtaaccgtacggtacggtacgtcggtaccgaccgtacttacgttacgttaccgtttacgtccttaaaaaaaaaaaaaaaaaaccgttccccgtaccctacgtcg

SEQ ID NO: 5528 - DNA, 525 bp, Homo sapiens
  misc_feature: GYAE6OF02I9TND.8.28.C06.1.454.CMB.1.raw
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagtttcagataccaccggagagattgtgttgacacaatctccagccaccctgtcttcgtctccaggggaaagngccaccctctcctgcagggccagtcagaatgttggcgcctacgtatcctggtaccaacagaaacctggccaggctcccaggcccctnatctatggtgcatccaacgagggccactggcactcccagccaggttcagtggcaggtgggtatgggacagacttcactctcaccatcatcagcctggagctgaggatgtgctagtttattactgtacaactatcgtacgagtcggccgtccggggcctacgtttccggccgtcggaccgaagtggatagtacgaaacgtactggtgtcgtgacacatctcgtctctac

SEQ ID NO: 5529 - DNA, 514 bp, Homo sapiens
  misc_feature: GYAE6OF02GQU3M.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcaccatcaataacctgcaatctgacgactttgctagtttattctgtcagcagttctgaagtactggccgttcacgtttcggcggagggaccaagggtcgacctcgaacgactgtggctgcacatctgtcttcattcctccgctatcg

SEQ ID NO: 5530 - DNA, 522 bp, Homo sapiens
  misc_feature: GYAE6OF02HAKG3.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccccagactcctcatctttggcgcctttaacagggccagtggaatcccagccaggttcagcggcagtgggtctgggacttcgttcactctcaccatcaataacctgcaatctgacgactttgctagtttattctgtcagcagtctgaagctggccttcactttcggcggtagggaccaagggtcggacctacaaacgactgtcggctggccaccattcctgtcttcacttccttcccgccatc

SEQ ID NO: 5531 - DNA, 529 bp, Homo sapiens
  misc_feature: GYAE6OF02GGSD3.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccccagactcctcatctttggcgcctttaacagggccagtggaatcccagccaggttcagcggcagtgggtctgggacttcgttcactctcaccatcaataacctgcaatctgacgactttgctagtttatttctgtcagtcagtctgaagctggccgttcacgtttcggcgggagggaccaagggtcggacctacgaaaccgaactgtcggcgtgccaccatctgtcttcattccttcccgcctatccg

SEQ ID NO: 5532 - DNA, 525 bp, Homo sapiens
  misc_feature: GYAE6OF02HBS5H.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgaggccagtcagagcgttaggacgaacttagcctggtatcagcagaggcctggccaggctcccagactcctcatctttggcgcctttaacagggccagtggaatcccagccaggttcagcggcagtgggtctggggacttcgttcactctcaccatcaataacctgcaatctgacgactttgctagtttatttctgtcagcagtctgaagactcggccgttcaccttttcgggcggtagggacctaagggtcggacctcgaaaccgactgtggctgcacatctagtcttcatccttcccgctatcg

SEQ ID NO: 5533 - DNA, 522 bp, Homo sapiens
  misc_feature: GYAE6OF02HACNL.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctggggacttcggttcactctcaccatcaataaccctgcaatctgacgtactttgctagtttatttctgttcagcagtctgaagactggccgttcactttcggcggagggaccaagggtcggacctcgaaacgactgtggcgtgcacatctgtcttcatccttcccgctatcg

SEQ ID NO: 5534 - DNA, 519 bp, Homo sapiens
  misc_feature: GYAE6OF02GRR0A.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactgggccttcacgtttcggcggagggaccaagggtggacctcgaacgactgtggctgccaccatctgtcttcattccttcccgcctatcg

SEQ ID NO: 5535 - DNA, 630 bp, Homo sapiens
  misc_feature: GYAE6OF02I42HP.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggagggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatcgtttggctcctttaacgagggtccaggtaggaactcccgagccaggttcagcggcagtgggtcgtgggtacttcggttcactctcacctatccaatacctgctaatctagacgtactttgaccttagttttactttcgtacgttacgtacgtacgttacgtcttacggtaagtaccgttcgggtcccttcgttaccgtttccgggacgggtacgggtaccgtaacggggttcggaaaccgtaccgtaaaacggcttacggtggtacctcggtaccaccgtattccgttacggttactttccgtaacttcccgtttaccccgaccgtattacccgg

SEQ ID NO: 5536 - DNA, 527 bp, Homo sapiens
  misc_feature: GYAE6OF02JAVPE.8.28.C06.1.454.CMB.1.raw
  modified_base (524)..(524): a, c, t, g, unknown or other
  misc_feature (524)..(524): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaaataacctgcaatctagacgactttgctagtttatttctgtcagtcagtctagaagtactggccgtttcacgtttcgggcggtagggacctaagggtcggacctacgaaacgactgtcggctgcacatctgtcttcactctcccgctntcg

SEQ ID NO: 5537 - DNA, 607 bp, Homo sapiens
  misc_feature: GYAE6OF02GS71C.8.28.C06.1.454.CMB.1.raw
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
tcagctcgcgtgtccacgaccggtgctcgatttagagctcacgtattggggttggggaggtaactgcttcagttaggacccagacggaaccatggaagccccagcgcagcttactctttcctcctagtcttactctggctccagagatcattcggacgaagttggtcgaagtacgaacgacgaagtctaccggtcacccgtggtctgttttccngggganagtagcctaccctctccttcgtcgcggtccaggtcagacgcgttaggacgtaacttaggcccgtggtatcgaagccgagaggcctggccaggcctcccagactcctcatctttggcgtcctttaacagggccagtcggaactccagccaggttcagcggcagtggtctgggacttcgttcacgtctcaccatcaaataacctgcaatctgactacttgctagtttatttctgtcacgcagttctagaagtacgtacggtcccgtttacaccgtttccgggacgggtacgggaccgtaagggtcgaccttacgaaacgacgtaggtcggactcggacctaccacgttccgttggttccttcgtacttcccgttcccgtcctactacgg

SEQ ID NO: 5538 - DNA, 571 bp, Homo sapiens
  misc_feature: GYAE6OF02HSWEC.8.28.C06.1.454.CMB.1.raw
  modified_base (537)..(537): a, c, t, g, unknown or other
  misc_feature (537)..(537): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcgcagtcagagcgttaggacgaacttagcctggtatcagcagaggcctggccaggctcccagacctcctcattctttggccgtacctttaacgacgggccaggtggaactccccagcctaggttcaggcggcaggtgggtctgggacttcgtcactcgtcaccatacaataacctgacaatctgacgtactttgcttattttattctgtcagctagtctaggaagtactcgggtccgttactaccgtttcgggacgggaacgggaaccgtaagggtcggaacctacgaaacgtacgtgtcggacgtcgccaaccgtnttccgtgttcttcacttcccgtcccgcctatccg

SEQ ID NO: 5539 - DNA, 516 bp, Homo sapiens
  misc_feature: GYAE6OF02FTLKC.8.28.C06.1.454.CMB.1.raw
  modified_base (426)..(426): a, c, t, g, unknown or other
  misc_feature (426)..(426): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctggggacttcgttcactctcaccatcaatacctgcaatctgacgactttgctagtttattctgtcagcagtctgaanactggccgttcacgtttcggcgggtagggaccaaggtggacctacaaacgtactgtggctgcaccatctgtcttcactcttcccgcatcg

SEQ ID NO: 5540 - DNA, 535 bp, Homo sapiens
  misc_feature: GYAE6OF02GAL12.8.28.C06.1.454.CMB.1.raw
  modified_base (532)..(532): a, c, t, g, unknown or other
  misc_feature (532)..(532): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacgaggccagtggaactcccagccaggttcagcggcagtgggtctgggacttcgtcactctcacatcaataacctgcaatctgacgtactttgctagtttattctgtcagtcagttctagaagtactgggcctttcgactttccgggacggtacgggacctaagggtcgaccttacgaaacgtactgaggctcgacaccatcgtgtcttcacttcctcccgactntcg

SEQ ID NO: 5541 - DNA, 525 bp, Homo sapiens
  misc_feature: GYAE6OF02HVNH7.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgatactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaatcccagccaggttcagcggcagtgggtctgggacttcgtcactctcaccatcaatacctgacaatctgacgtactttgctagtttattctgtcagctagtctagaagctggtccgttcacgtttcgggacggagggaccaagggtcggacctacgaaacgactggtggctgacacatctgtcttcattccttcccgctatcg

SEQ ID NO: 5542 - DNA, 527 bp, Homo sapiens
  misc_feature: GYAE6OF02IGLC9.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagctagtctgaagactggccgtttcacgttttcgggcgggtagggaccgaagggtcggacctacgaaacgactgtggcgtgcacatctgtcttcattcctcccgcctatcg

SEQ ID NO: 5543 - DNA, 597 bp, Homo sapiens
  misc_feature: GYAE6OF02IZ1Z5.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagacgccaccctctcctgtgcggccagtcagagcgttaggacgaacttagcctggtatcagcagaggcctggccaggctcccagactcctcatctttggctcctttaacaggccaggtgaactcccagccaggttcagcggcaggtgggtctgggacttcgttcactctcaccatacaataacctgacaatctagacgtactttgacttagtttattctgtcagtctagtctagaacgtacgtcggtaccgttcgtaaccgtttccgggacgggtaacgggtaccgtaacggtcgggtaacctacgaaaacgtacgttggtcggtacgtcggacctaaccgtacttaccgtcgttaccttacgtacctttcccgttaccccgtcctacgttaccgg

SEQ ID NO: 5544 - DNA, 532 bp, Homo sapiens
  misc_feature: GYAE6OF02JKKGT.8.28.C06.1.454.CMB.1.raw
  modified_base (199)..(199): a, c, t, g, unknown or other
  misc_feature (199)..(199): n is a, c, g, or t
  modified_base (315)..(315): a, c, t, g, unknown or other
  misc_feature (315)..(315): n is a, c, g, or t
  modified_base (529)..(529): a, c, t, g, unknown or other
  misc_feature (529)..(529): n is a, c, g, or t
tcagctcgcgtgtccacgaccggtgctcgatttagagctcacgtattgggtttgggggtagggaacgtggctcagttaggacccagacggaaccatggaagccccagcgcagcttctcttcctcctgctactctggctcccagagatcattggagaagtggtgatgacacagtctccggtcaccctgtctgtttttccnggggtagagagccaccctctcctgtgcggccagtcagagcgttaggacaacttgcctggtatcagcagaggcctggccaggctcccagacctcctcatctttggcgtcctttaacngggccagtggaatcccagccaggttcagcggcaggtgggtctgggacttcgttcactctcaccatcaatacctgcaatctgacgtactttgctagtttattctgtctagctagtctagaagtactggccttcactttcgggcggtagggaccaagggtcggacctacgaaacgactgtggctggcacattctagtcttcacttccttcccgccntcg

SEQ ID NO: 5545 - DNA, 535 bp, Homo sapiens
  misc_feature: GYAE6OF02ISHGD.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagaatgttggcgccttcgtaagctggtaccaacacaaacctggccaggctcccaggccccctcatctatggtgcatccaacagggccactggcatcccagccaggttcagtggcagtgggtatgggacagacttcactctcacatcatcagcctggagcctgagatgttgctagtttattactgtcaacatcgtacgagtcggccgtccgggggcctacgtttccggcccgttgggacccgtaagggtaggagactacgaaacggaacgtacggtggtactgccaccactctgtcttcacttcccg

SEQ ID NO: 5546 - DNA, 566 bp, Homo sapiens
  misc_feature: GYAE6OF02H30HJ.8.28.C06.1.454.CMB.1.raw
  modified_base (148)..(148): a, c, t, g, unknown or other
  misc_feature (148)..(148): n is a, c, g, or t
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
  modified_base (407)..(407): a, c, t, g, unknown or other
  misc_feature (407)..(407): n is a, c, g, or t
tcagctcgcgtgtccacgaccggtgctcgatttagagctcacgtattgggtttggggtaggaacgtgctcagttaggacccagacggaaccatgaagcccagcgcagcttctcttctcctgctactctggctccagagatcattgganaagtggtgatgacacagtctccggtcaccctgtctgttttccnggganagagccacctctcctgtgcggccagtcagagcgttaggacgtaacttagcctgggtatcagcagaggcctggccaggctcccagactctcatctttggccgtcctttaacncgggtccagtgaactcccagccaggttcaggcgnaggtgggtctgggactttcgtcacgtctcgaaccatcaataacctgacaatctagacgtactttgntagtttattctgtcagtactagtctagaagtctggtcctttctaacgtttcggacgggtaagggaccaaagggtcggaacctacgaaaaccgatacggtggtctcggactacccaagttcctagttccttactattacccttcccggtcccagttaccg

SEQ ID NO: 5547 - DNA, 587 bp, Homo sapiens
  misc_feature: GYAE6OF02HGMY9.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcttggcctcctttaacagggccagggtgaactcccagccaggttcaggcggcaggtgggtctgggacttcgtcactctcaccatcaataacctgacaatctgacgtactttgactagtttactttctgtcagtctagttcgtagaagtacgtcggtaccgttcgtaccgtttcgggacgggtacgggaaccgtaagggtcggtaacccgtacgaaaccggtaacgtggtacggtccgtcggtcctaacccgtattccgtgttccttactacttcccttccccgtacctactccg

SEQ ID NO: 5548 - DNA, 637 bp, Homo sapiens
  misc_feature: GYAE6OF02IZ07D.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcattcttggcgtcctttaacgagggccagtcggaatcccagccaggttcagcggcaggtgggtctgggacttcgtcactctcacatcaatacctgacatctgactactttgcttagtttactttcttgtcagtctagtcttaggaacgtacgtgggtccctttcgtaccgttttccggggaccggggtaacggggtaacccgtaaacggggttacggtaaccccgttaaacgaaaaccggtaaccgttgggttacgggtaccgttcggaccctaaccgtaacgttaccgtttcggttaccctttaccgtaaccgtttcccgttaccccccggtacctacgttacccg

SEQ ID NO: 5549 - DNA, 531 bp, Homo sapiens
  misc_feature: GYAE6OF02JX7GO.8.28.C06.1.454.CMB.1.raw
  modified_base (300)..(300): a, c, t, g, unknown or other
  misc_feature (300)..(300): n is a, c, g, or t
  modified_base (371)..(371): a, c, t, g, unknown or other
  misc_feature (371)..(371): n is a, c, g, or t
  modified_base (505)..(505): a, c, t, g, unknown or other
  misc_feature (505)..(505): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcttggcncctttaacagggccagtggaactccagccaggttcagcggcaggtgggtctgggacttcgtcactctcacntcaataacctgcaatctgacgtactttgctagtttattctgtcagtcagtctgaagtacgtggtccgttctacgtttcgggacgggtacgggacctaagggtggacctacgaaacgtactggaggcgtcgcacntctgtcttcactccttcccgctatcg

SEQ ID NO: 5550 - DNA, 538 bp, Homo sapiens
  misc_feature: GYAE6OF02IJ5CD.8.28.C06.1.454.CMB.1.raw
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcttggcncctttaacngggccagtggaatcccagccaggttcagcggcaggtgggtctgggactttcgtcactctcaccatcaataaccctgacaatctcgacgtactttgctagtttattcttgtcagctagtctgaagtactggtccgttctacgtttcgggcgggtagggtaccgaagggttcggacctacgaacgacgtgtcggcgtcgcacctatctgtcttcacttcctccgcctatcg

SEQ ID NO: 5551 - DNA, 529 bp, Homo sapiens
  misc_feature: GYAE6OF02G9J8E.8.28.C06.1.454.CMB.1.raw
  modified_base (509)..(509): a, c, t, g, unknown or other
  misc_feature (509)..(509): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaactccagccaggttcagcgcagtgggtctgggacttcgtcactctcaccatcaataacctgacaatctgacgtactttgctagtttattctgtcagtcagttctgaagtactggtccgttctaccgtttcgggacggtagggaccgtaagggtcggacctacgaaacgactgtaggctgcacatcgtntcttcattcctcccgcatcg

SEQ ID NO: 5552 - DNA, 535 bp, Homo sapiens
  misc_feature: GYAE6OF02FTXEM.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacaggccagtggaatcccgagccaggttcagcggcagtgggtctgggacttcgtcactctcaccatcaataacctgacaatctgacgactttgctagtttattctgtcagcagtctgaacgtctggtccttcgtacgtttcggcggtagggaccgtaaggtcgacctacgaacgactagtcggcgtgccacctatcgtgttcttcgtacttccttcccgtcctagtccg

SEQ ID NO: 5553 - DNA, 531 bp, Homo sapiens
  misc_feature: GYAE6OF02JJICD.8.28.C06.1.454.CMB.1.raw
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccagtggaatcccagccaggttcagcggcagtgggtctgggacttcgttcactctcaccatcaataacctgcaatctgacgactttgctagtttatttctgtcagcagttctgaagactggtccgttcactttcgggcggagggaccaaggttcggacctacgaaacgtaacgtgtggctggacaccgatctgtcttcacttccttcccgctacttcg

SEQ ID NO: 5554 - DNA, 603 bp, Homo sapiens
  misc_feature: GYAE6OF02I1KWF.8.28.C06.1.454.CMB.1.raw
  modified_base (316)..(316): a, c, t, g, unknown or other
  misc_feature (316)..(316): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcattctttggccgtcctttaacgngggccaggtggaactcccagccaggttcagcggcaggtgggtctgggactttcgtcactctcacctatcaataacctgacaatctgacgtactttgcttagtttatttctgtcacgtctagttctagaacgtacttgggccgttactaccgtttcggacgggtaacgggaccgtaagggtacggtacccgtaacgaaaccggtacgtacggtacggcgtcggaccaaccgtacttaccgttcggttaccttacgtaaccttcccgttccccgtaccttacgttaccg

SEQ ID NO: 5555 - DNA, 598 bp, Homo sapiens
  misc_feature: GYAE6OF02JEDFH.8.28.C06.1.454.CMB.1.raw
  modified_base (316)..(316): a, c, t, g, unknown or other
  misc_feature (316)..(316): n is a, c, g, or t
  modified_base (381)..(381): a, c, t, g, unknown or other
  misc_feature (381)..(381): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttcctggggagagagccaccctctcctgtgcggccagtcagagcgttaggacgaacttagcctggtatcagcagaggcctggccaggcctcccagacctcctcattcgtttggcgtcctttaacgngggccagtcggaactcccagccaggtcaggcggcaggtgggtctgggacttcgtcactctcactntaccaataacctgactatcgtacgacgtactttcgacttagtttatttctgtacagtctagttctagaagtacgtcggtccgttcgtaccgtttcgggacgggtacgggtaaccgtaagggtccggaaccgtaacgaaacgtacgttaggtacggtaccgtggacctaccgagttccgttgttccttacgtacttcccgtcccgtacctacgttccg

SEQ ID NO: 5556 - DNA, 520 bp, Homo sapiens
  misc_feature: GYAE6OF02H8AFA.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaatcccagccaggttcagcggcagtgggtctgggacttcgttcactctcaccatcaataacctgcaatctgactactttgctagtttattctgtcagcagtctagaagactggccgttctacgtttcggcggagggaccaagggtggacctacaaacgactgtggcgtgacacatctgtcttcatcctcccgtccatcg

SEQ ID NO: 5557 - DNA, 515 bp, Homo sapiens
  misc_feature: GYAE6OF02FQ96O.8.28.C06.1.454.CMB.1.raw
  modified_base (310)..(310): a, c, t, g, unknown or other
  misc_feature (310)..(310): n is a, c, g, or t
  modified_base (494)..(494): a, c, t, g, unknown or other
  misc_feature (494)..(494): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccagtggaatcccagccaggttcagtggcagtgggtctgggacttcgttcactctcaccatcaataacctgcaatctgacgactttgctagtttatttctgtcagcagtctgaagtactggccgttcacgtttcgggcggtagggaccaagggtcgacctcgaaacgactgtggctgcacntctgtcttcatcctccgcatc

SEQ ID NO: 5558 - DNA, 586 bp, Homo sapiens
  misc_feature: GYAE6OF02IK5X3.8.28.C06.1.454.CMB.1.raw
  modified_base (233)..(233): a, c, t, g, unknown or other
  misc_feature (233)..(233): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcaggngcgttagacgactgctggtatcagcagaggcctggccaggctcccagactcctcatctttggcgtccttaagagggccagtggaatccagccaggtcagcggcagtgggtctgggacttcgttcactctcacatcaataacctgacaatctacgacgtactttgactagtttacttctgtcagctagtcttagaacgtactcggtccgttacgtacgtttccgggcgggtaacgggaccgtaacgggtcggaacccttaaccgaaaccgtaacgtacggtacggcgttcggaccaccgtaacttccgttacgttccgttacctacgttcccgttaccccgtccgtacttaccg

SEQ ID NO: 5559 - DNA, 633 bp, Homo sapiens
  misc_feature: GYAE6OF02HC1OF.8.28.C06.1.454.CMB.1.raw
  modified_base (195)..(195): a, c, t, g, unknown or other
  misc_feature (195)..(195): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
  modified_base (405)..(405): a, c, t, g, unknown or other
  misc_feature (405)..(405): n is a, c, g, or t
  modified_base (594)..(594): a, c, t, g, unknown or other
  misc_feature (594)..(594): n is a, c, g, or t
tcagctcgcgtgtccacgaccggtgctcgatttagagctcacgtattgggtttgggggaggaactgctcagttaggacccagacggaaccatggaacgccccagcgcagcttctcttcctcctgctactctggctcccagagatcattggagaagtggtgatgacacagtctccggtcacctgtcttgttttcgngggagagcgccacctctctgcgcgcagtcgagngtacgtagactacgtcgcgtagtangagacgagcgcgtcgcgacgccnccgatcctctactcttcgttcggccttaccgttaacggcggactaggtacgacctccgacgtcgtaggtcgacggcgacgtggtcggtcggtaggtcctttcgtacactcacactatactaactacgtnactactctacgtacgttacgttcgtattagtttacttcgttcgtacgtacgtacgtacgtacgtagacgtacgtcgtcgttcgttacgttcgggtacgggtacggacggtacggtacggtaccgtaacgtaacgtacgtacggtacggtcgtcgaccgacgtttttttttttttttttttttttttacncgttacgttcttactaccttccgttcccgtacctactcg

SEQ ID NO: 5560 - DNA, 715 bp, Homo sapiens
  misc_feature: GYAE6OF02J3Z56.8.28.C06.1.454.CMB.1.raw
  modified_base (210)..(210): a, c, t, g, unknown or other
  misc_feature (210)..(210): n is a, c, g, or t
  modified_base (471)..(471): a, c, t, g, unknown or other
  misc_feature (471)..(471): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctccgagagatcagttggagaagtgtgatcgacacgtcgtccgtccggtctaccgttgttcgtttcggtttaccggnggggacacgctccctcctctccgtgtcgccgacagtcgagacgtacgttagacttaacgtcgcgttagactcgagacgacggcgtcgcggccaccggtcctaccgatccctcgtacttacgttcgtacggaccgttacgtaacggcggactaggtacgaaccctcgacgtccggtaggtcgacggtcggtacgttcgggtcgttcgtacggttaccttccgtacaccgttcaaccgaaccttacgtaacctaaccgttacnggtaaccttacgtcggttaccgttacgttacgttacgttacgtttaagtttccgttacgtacacgttaccgtacgttaccgttacgtaccgtaacgttccggttaccgtacgttacgtaccgggtacggaacgggtaacgtacggtacggtaccaacgtacgtaaccgtcgtcgtacctcgtaccacctaacggttctccgttaaccgttcttaccgtacccgtccgaccgtacgtcgtaccgg

SEQ ID NO: 5561 - DNA, 534 bp, Homo sapiens
  misc_feature: GYAE6OF02IAA6V.8.28.C06.1.454.CMB.1.raw
  modified_base (430)..(430): a, c, t, g, unknown or other
  misc_feature (430)..(430): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcttttggcgtcctttaacagggccagtggaatcccagccaggttcagcggcagtgggtctgggacttcgttcactctcaccatcaaataacctgacaatctgacgtactttgactagtttattctgtcagtctagtntgaagactggccgttctacgtttcggcgggtagggaccgaaggtcggacctacgaacgactgtggctgcactatctgttcttctacttccttcccgcctatccg

SEQ ID NO: 5562 - DNA, 545 bp, Homo sapiens
  misc_feature: GYAE6OF02HJYDB.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggctcctttaacagggccagtggaatcccagccagttcagcgcagtgggtctgggacttcgttcactctcaccatcaataacctgacaatctgacgtactttgctagtttattctgtcagctagtctgaacgtacgtcggtccgttctaccgtttcggacgggtacgggaccgtaagggtcggacctacgaaacgacgtagtcggtctgccacacgtctagttcttctacttccttcccgcctatccg

SEQ ID NO: 5563 - DNA, 520 bp, Homo sapiens
  misc_feature: GYAE6OF02FNZ2S.8.28.C06.1.454.CMB.1.raw
  modified_base (487)..(487): a, c, t, g, unknown or other
  misc_feature (487)..(487): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagtggcagtgggtctgggacttcgtcactctcaccatcaaataacctgacaatctgacgtactttgctagttttattctgtcagcagtctgaagtctggtccgttcacgtttcggacgggtagggaccaagggtgacctacaaacgactgnggctggccacatctgtcttcatcctcccgcatc

SEQ ID NO: 5564 - DNA, 617 bp, Homo sapiens
  misc_feature: GYAE6OF02JU47C.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttgcctggtatcagcagaggcctggccaggctcccagactcctcatctttggcgtcctttaacagggccagtggaactcccagccaggttcagcggcagtgggtctgggacttcgtcactctcaccatcaataacctgacaatctgacgtactttgactagtttatttctgtcagtctagttcgtagaacgtactcgggtaccgtttcgtacgtttccgggacgggtaacgggtaccgtaaggggttcggaacccgtaacgaaaacggtaaccgttgggtacggtaccgtacggacctaaccgtaacgtttccgttacggtttactttacccgtaacgtttcccgtttacccccggtacgtacttacccgg

SEQ ID NO: 5565 - DNA, 523 bp, Homo sapiens
  misc_feature: GYAE6OF02GGNHY.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcaccatcaataacctgcaatctgacgtactttgctagttttatttctgtcagcagtctgaagactggtccgttcacgtttcgggcggagggaccaagggtcggacctacaaacgactgtggctgcacatctgttcttcacttccttcccgctatcg

SEQ ID NO: 5566 - DNA, 540 bp, Homo sapiens
  misc_feature: GYAE6OF02GN992.8.28.C06.1.454.CMB.1.raw
  modified_base (316)..(316): a, c, t, g, unknown or other
  misc_feature (316)..(316): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacngggccactggcatcccagccaggttcagtggcagtggtatgggacagactttactctcaccatcatcagcctggacgcctgagatgttgctagtttattactgtacaactatcgtacgagtcggccgtccggggcctacgttccggcccgtcgggaccgtaagggtcggacgagtacgaacggtaacgtagtcggctgccaccgtactcgtgtcttcattcccg

SEQ ID NO: 5567 - DNA, 952 bp, Homo sapiens
  misc_feature: GYAE6OF02IPY10.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtactcgagcaggacggccgtcggccgaggtccctccgaacgtaccttccctactactttccgtttcgggcccgttacccttttaaacggaccgggtaccgtaggtacgggaacccttaccccgacggacccgttacgggttaccgacgggccgggtactaggtttcgggggtaccgttacggggtaaccttttccggtttaccaaccttccgtacccaaccctacttaaccaaaaccttaacccgtgtaacctaaacttcgtaacggtaacccgttacttttacggacctttaacggttttttaactttccgttacgttaccgtacggtaccgttacggttaccgttaagggtaaacggtaccggttaccgggggtttacccccgtttttaacccgtttaacccggggttttttcccgggggggaaaccggggggttaaacccggggggtaaaccccggtttaaaggggggtttaccccgggtaaaaccccgtttaaaacccgggaaaaacccgggtttaaaccgggttcgggggttaccgggtaccccgggtttaaccgggtaacccccgttaaacccgtttaaccggttttacccggtttaccggtttttaccccgtttaaacccggttaaccccgtttttcccccccgggttttaacccccccgggtaccctttaacccgttttacccccgggg

SEQ ID NO: 5568 - DNA, 525 bp, Homo sapiens
  misc_feature: GYAE6OF02IUAHK.8.28.C06.1.454.CMB.1.raw
  modified_base (501)..(501): a, c, t, g, unknown or other
  misc_feature (501)..(501): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaatcccagccaggttcagcggcagtgggtctgggacttcgttcactctcaccatcaataacctgacaatctagacgtactttgctagtttattctgtcagctagtctagaagactggtccgttctacgtttcggacggagggaccaaggtcggaacctcgaaacgactgtcggctgcacntctgtctcactcctcccgctatcg

SEQ ID NO: 5569 - DNA, 505 bp, Homo sapiens
  misc_feature: GYAE6OF02I4LQ2.8.28.C06.1.454.CMB.1.raw
  modified_base (407)..(407): a, c, t, g, unknown or other
  misc_feature (407)..(407): n is a, c, g, or t
  modified_base (430)..(430): a, c, t, g, unknown or other
  misc_feature (430)..(430): n is a, c, g, or t
  modified_base (501)..(501): a, c, t, g, unknown or other
  misc_feature (501)..(501): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagagcctggccaggctcccagactcctcatctttggcgctttaacagggccagtgaatccagccaggttcagcgcagtgggtctgggacttcgtcacgtctcaccatcaatacctgcatctgacgactttgctagtttatttctntcagcagtctgagactgccgttnacgtttcgcggagggaccgaagggtggacctcgaaccgactgtggcgtcgcacatctgtcttcatctcccncatc

SEQ ID NO: 5570 - DNA, 538 bp, Homo sapiens
  misc_feature: GYAE6OF02JCJ4L.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaactcccagccaggttcaggcggcaggtgggtctaggacttcgtcactctcaccatcaataacctgacaatctagacgtactttgctagtttattctgtcagtctagtctgaacgtctcggtccttctacgtttcgggcgggaacgggaccgtaaggtcggacctacgaaacgactgtcggctgccaccattcgtgtccttcactcctcccgcatcg

SEQ ID NO: 5571 - DNA, 561 bp, Homo sapiens
  misc_feature: GYAE6OF02HR0J8.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaatcccagccaggttcagcggcagtgggtctgggacttcgtcactctcaccatcaataacctgacaatctgacgtactttgctagtttattctgtcagctagtctgaagtacgtggtccgtttcaccgttttcgggacgggtaacgggaccgtaagggttcggaccgtacgaaacgaacgttggtacggcgtcgccacctatccgttgtcctttcacttcccttccccgtacctattccg

SEQ ID NO: 5572 - DNA, 569 bp, Homo sapiens
  misc_feature: GYAE6OF02FM9MF.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaatcccagccaggttcagcggcagtgggtctgggacttcgtcactctcaccatcaataacctgacaatctgacgactttgctagtttatttctgtcagcagtctagaagtactcggtccgttctaccgtttcgggacgggtagggaccgaagggtcggtaacccgtacgaaaccggaacgttcggtacggccgtcggcctaaccgaacttccgtgttcctttctaccttttccccgcctactctacgg

SEQ ID NO: 5573 - DNA, 532 bp, Homo sapiens
  misc_feature: GYAE6OF02HA319.8.28.C06.1.454.CMB.1.raw
  modified_base (526)..(526): a, c, t, g, unknown or other
  misc_feature (526)..(526): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagactcctcatctttggcgtcctttaacagggccagtggaatcccagccaggttcagcggcaggtgggtctgggcttcgttcactctcaccatcaataacctgacaatctgacgtactttgcttagttttattctgtcagtctagtctgaagtacgtggtccgttcaccgtttcggacgggaggaccgaagggtcggacctacaacgactgtgctgactaccatctgtcttcactccgtcccnctatcg

SEQ ID NO: 5574 - DNA, 994 bp, Homo sapiens
  misc_feature: GYAE6OF02GNHVK.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccgtggggagagacgccaccctctcctgtgcggccagtcagagtcgttaggacgtaacttagccgtggtatcagcaggacggccgtggccaggcctcccgagacctcctctattcgtttggccgtaccctttaaacggacggggtccctaaggtacgggaaaccttcccccgaaggaccccgtaagggtttaccgaacgggtcccgggaccgtaacgggttcgggggttaccggttacggggggttaacccgttttccgggtttaccgtaaccctttccgtaacccctaaccccgtaaacttacccgtaaaaaccgtttaaaccccgtttggaaccctaaacgtttacccgttaacgggtaaacccggtttaaccgtttttacgggtaacccgttttaaacggtttttttaacctttttaccgtttacggtttacccgtaacggttaccgtaacgggtttaccgttaacgggtaaaacggttacccggttaccggggtttaccccggttttaacccggttaacccgggtttttttacccggggggacccggggggttaaaccgggggttaaaccccgggttaaaaccggggggtttaacccggggtaaaccccgttaaacccggtaaaaaacccggggttaaacccggtttacggggttaccggggtacccggttaaccgggtaaccccgtaaaccccggttaaccgtttaccccggtttacggttttaccccgttttacccggttaacccgttttacccccggttttaccccccggtaccccgttaaccgtttaccccggg

SEQ ID NO: 5575 - DNA, 523 bp, Homo sapiens
  misc_feature: GYAE6OF02F5BDL.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccccagactcctcatctttggcgcctttaacagggccagtggaatcccagccaggttcagcggcagtgggtctgggacttcgtcactctcaccatcaataacctgcaatctgacgactttgctagtttatttctgtctagctagtctgaagactggtccgttcacgtttcggcggagggaccaagggtcggacctagaacgacgtgtggctcgacaccagtctgtcttcattcttctccgctac

SEQ ID NO: 5576 - DNA, 517 bp, Homo sapiens
  misc_feature: GYAE6OF02G8NGJ.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggctcctttaacagggccagtggaatcccagccaggttcagcggcagtgggtctgggacttcgtcactctcaccatcaataacctgcaatctgacgactttgctagtttattctgtcagcagtctgaagactggccgttctacgtttcggcggtagggaccaagggtcgacctacgaacgactgtaggctgcacatctgtcttcattcctcccgctatcg

SEQ ID NO: 5577 - DNA, 541 bp, Homo sapiens
  misc_feature: GYAE6OF02GYXH9.8.28.C06.1.454.CMB.1.raw
  modified_base (372)..(372): a, c, t, g, unknown or other
  misc_feature (372)..(372): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcaccntcaataacctgcaatctagacgtactttgctagtttattctgtcagcagttctagaagtactggtccgttcacgtttcggacgggtacgggaccgtaaggtcggacctacgaaacgtactgtcggctgaccaccatcgtgttcgttcacgttccttacccgcctattcg

SEQ ID NO: 5578 - DNA, 515 bp, Homo sapiens
  misc_feature: GYAE6OF02HPQH2.8.28.C06.1.454.CMB.1.raw
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagcccaccctctcctgtgcggccagtcagagcgttaggacgaacttagcctggtatcagcagaggcctggccaggctcccagactcctcatcttggcgtcctttaacgngggccagtggaatcccagccaggttcagcggcagtggtctgggacttcgtcactctcacatcaatacctgacatctgactactttgctagtttattctgtcagtcagtctagaacgctcggccgttcacgtttcggcgggaggaccgaagggtcgacctacgaaacgatgtgctgcacatctgtcttcacttctcccgcatcg

SEQ ID NO: 5579 - DNA, 678 bp, Homo sapiens
  misc_feature: GYAE6OF02J3D9N.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagagccaccctctcctggtgcggccagtcagagcgttaggacgaacttgcctggtatcagcagacgctggccaggcctccaagtcctcctctacttcgttcggaccttaccgttaaacgcggtaccaggtacggaacctcccgagccgtacggttcgacggcggtcgtaggtcggtcgtacgggtactttcgtcacgtctacgaacctacgtactaactaccgtcgactaacttcgtacggtaccgttacgtttaggtactttaagtttttactttcgtacgtacgagtacctaggttcgtagtaaacgtccgtcgggtaccctttacgtaccggtttaccggggacggtaaccgggtacgttaacggggtaccaacccgtaacgtaaaccgtacgttggacggtccgtaacgtccaaccgttcgttaccgtcgtttaccttacgaccgtttccctaccccggtacttacgttaccgg

SEQ ID NO: 5580 - DNA, 508 bp, Homo sapiens
  misc_feature: GYAE6OF02F4GQH.8.28.C06.1.454.CMB.1.raw
  modified_base (438)..(438): a, c, t, g, unknown or other
  misc_feature (438)..(438): n is a, c, g, or t
  modified_base (506)..(506): a, c, t, g, unknown or other
  misc_feature (506)..(506): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttattctgtcagcagttctgaagctggccgttnacgtttcggcggtaggaccaagggtcgacctcaaacgtactgtgctgcacatctgtctcatctccgcntc

SEQ ID NO: 5581 - DNA, 539 bp, Homo sapiens
  misc_feature: GYAE6OF02G584B.8.28.C06.1.454.CMB.1.raw
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcncctttaacngggccagtggaatcccagccaggttcagcggcagtgggtctggggacttcgttcactctcacatcaatacctgcatctgacgactttgctagtttattctgtctagcagtctgaagtactggtccgttctacgtttcggcgggtacgggaccgtaagggtcggacctaccgaacgtaactggtaggcgtcgctaccatcttgtcttctacttttcccgcctactcgtacg

SEQ ID NO: 5582 - DNA, 563 bp, Homo sapiens
  misc_feature: GYAE6OF02HVX02.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (350)..(350): a, c, t, g, unknown or other
  misc_feature (350)..(350): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgtaacttagccttggtatcagcagaggcctggccaggctcccagactcctcatctttggcgtcctttaacagggccaggtggaacttcccagccctaggttcaggcggnaggtgggtctgggacttcggtcactctcaccatcaatacctgacaatctagacgtactttgctagtttattctgtcagctagtctagtaagtcgtggtccgttctacgtttcgggcgggtacggaccgaagggtcggaacctaccgaaacgtactggtcggtactcgaccacctattccgtgtccttacacctttccgtcccgtcctataccg

SEQ ID NO: 5583 - DNA, 618 bp, Homo sapiens
  misc_feature: GYAE6OF02JOTVZ.8.28.C06.1.454.CMB.1.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
  modified_base (576)..(576): a, c, t, g, unknown or other
  misc_feature (576)..(576): n is a, c, g, or t
  modified_base (610)..(610): a, c, t, g, unknown or other
  misc_feature (610)..(610): n is a, c, g, or t
tcagctcgcgtgtccacgaccggtgctcgatttagagctcacgtattgggtttgggggtagggaacgtggcgtcagttaggacccagacggaaccatggaagcccagcgcagctctcttcctcctgctactctggctcccagagatcattggagaagtggtgatgacacagtctccggtcaccctgtcctgtttttccngggggtanagagccaccctctcctgtgcggccagtcagngcgttaggacgaacttgcctggtatcagcagaggcctggccaggcctcccgagactcctacatctttggctcctttaacgagggccctaggtcggaactcccgagccaggttccaggccggcaggtcggggtcttgggggacctttcggttcaccgttcgtccaaccgtataccgtaaattacccgtgacctaagtcctacgaacgtactttcgtactacgttttacttctgttcagtctacgtcgtagaacgtacgtcggtccgttctaccgtttcgggaccgggtacgggtaaccgtagggtcggacctacgaaaccgtactgtcggtacgtcganaccgtatcgtagtaccgttctacttccgttcccnctactacg

SEQ ID NO: 5584 - DNA, 534 bp, Homo sapiens
  misc_feature: GYAE6OF02GZFYY.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaactaacctgcaatctgacgactttgctagtttatttctgtcagctagtctgaagactggccgtttcactttcggcgggtagggaccaagggtcgacctacaaacgactggtcggcgtgcctaccacttcgtgtccttcacttcctttcccgcctatccg

SEQ ID NO: 5585 - DNA, 539 bp, Homo sapiens
  misc_feature: GYAE6OF02G0DEC.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcattcttggcgtcctttaacgagggccaggtggaactcccagccaggttcagcggcaggtgggtctgggacttcgtcactctcaccatacaataacctgacaatctgacgtactttgctagtttattctgtcagtctagttctagtaagtactgggtccgttcgtacgtttcggacgggtaggaccgtaaggtcggacctacgaacgactggtcggcgtgcacatctgtcttctacttcctccgctatcg

SEQ ID NO: 5586 - DNA, 638 bp, Homo sapiens
  misc_feature: GYAE6OF02J3XM0.8.28.C06.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (400)..(400): a, c, t, g, unknown or other
  misc_feature (400)..(400): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctccagagatcattggagaagtggtgatgacacagtcctccggtcacccttgtcttgttttccgngggganacgacgcccacccgttctcctggtcgccggcagtcaggacgtacgttaggaccgtaacttagcctaggtactcgagcgaaggtcggcctggccacggtcctacccgagtaccttcctactacgttccgtttcggaccgttaccgtttaacgcgggaccaggttacggaacctcccgagccgtaggtcacggcggcnggtcggtctcgggtcttcgtcactcacacatacaactactgactatcacgtactacgttgcttagtttattcgatcgagtctacgtcgtagaacgtccgttcggtaccgtttagtaccggtttacgggacggtacgggtaacctacggggtacacctaacgaaacgccggttgtacggtccgtacgcacttacgttctcgtttaccgtcctaccttcctaccccggtctaggtacccg

SEQ ID NO: 5587 - DNA, 558 bp, Homo sapiens
  misc_feature: GYAE6OF02H7HKB.8.28.C06.1.454.CMB.1.raw
  modified_base (310)..(310): a, c, t, g, unknown or other
  misc_feature (310)..(310): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacngggccagtggaactcccagccaggttcagcggcagtgggtctgggacttcgttcactctcaccatcaactacctgactaatctagtacgtactttcgcttagtttacttctgtacagtctagtctagaacgtcgtcggtccgttactacgtttcgggacgggagggaccgtaaggtcggaccgtacaaacgactggtacggtctcgaccactattccgtgttcttctacttcccttcccgcctactcg

SEQ ID NO: 5588 - DNA, 521 bp, Homo sapiens
  misc_feature: GYAE6OF02GDQ49.8.28.C06.1.454.CMB.1.raw
  modified_base (312)..(312): a, c, t, g, unknown or other
  misc_feature (312)..(312): n is a, c, g, or t
  modified_base (490)..(490): a, c, t, g, unknown or other
  misc_feature (490)..(490): n is a, c, g, or t
  modified_base (499)..(499): a, c, t, g, unknown or other
  misc_feature (499)..(499): n is a, c, g, or t
  modified_base (519)..(519): a, c, t, g, unknown or other
  misc_feature (519)..(519): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcatctttggcgtcctttaacngggccaggtggaactcccagccaggttcagcggcaggtgggtctgggacttcgtcactctcaccatcaactaacctgacaatctagacgtactttgctagttttattctgtcagcagtctagaagactggccttcacgtttcgggcggacggaccaaggtcggacctgaaacgactgnggctgcacntctgtctcactcctcccgcntc

SEQ ID NO: 5589 - DNA, 553 bp, Homo sapiens
  misc_feature: GYAE6OF02HNYV1.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacaggccaggtggaatcccagccaggttcagcggcagtgggtctgggacttcgttcactctcacatcaataacctgacaatctgacgtactttgctagttttattctgtcagtcagttctgaagtactcggccgttctaccgtttcgggcgggtacgggaccgaagggtcggaacctacgaaaccgactcgtaggcctggaccaccgattcgttagtccttacacttccttaccccgcctatccg

SEQ ID NO: 5590 - DNA, 569 bp, Homo sapiens
  misc_feature: GYAE6OF02IQL03.8.28.C06.1.454.CMB.1.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (310)..(310): a, c, t, g, unknown or other
  misc_feature (310)..(310): n is a, c, g, or t
  modified_base (395)..(395): a, c, t, g, unknown or other
  misc_feature (395)..(395): n is a, c, g, or t
tcagctcgcgtgtccacgaccggtgctcgatttagagctcacgtattggggtttgggggggaggaactgctcagttacggacccagacggaaccatggaaggccccagcgcacgcttctcttccctcctgctactctggctcccagagatcattgggagaagtggtggatgacacagtctccggtcaccctgtcttgtttttccngggganagagccacccctctcctgtgcggccagtcagagcgttaggacgaacttagcctggtatcagcagaggcctggccaggctcccagactctcatcttggcncctttacagggccagtggaactcccagccaggttcagcggcagtgggtctgggtacttcgttcactctcaccatcaactacctgntaatctagacgtactttgcttagtttattctgtcagctagtctagaacgacgtcgtcgttcctacgtttcgggacgggaacggaccgaagggtcggacctaacgaaacgtactggtacggcgtgacctacctatccgttgtaccttactacttcccgttacccgtctatacccg

SEQ ID NO: 5591 - DNA, 736 bp, Homo sapiens
  misc_feature: GYAE6OF02HWXRK.8.28.C06.1.454.CMB.1.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
tcagctcgcgtgtccacgaccggtgctcgatttagagctcacgtattggggtttgggggaggaactgctcaggttaggacccagaccggaaccgattggaaggcccctagcgtcagcttctcgttcctcctgctactctcggcctcccagaggattcgattggagaagtggtgtatgacactagttacgtccggtcacctgtctgttttccngggganagagccacctctccgtggtgcggcagtcaggaggcgttaggacgtaacttagcctggtatcagccaggacggtcctcggaccacggcctcccgagtacctcctcagttcgtttggccgtacccttaacgacgggccaggtaggaactcccgagccgtaggttcgacggtccggagtaggttcgggtcgtggggtactttcggttacacgttctaccgaacctataacctaaacgtaaccgtcgacctaacttccgtacggtaaccgttacgtttcgacttaacgttttacttacgttacgtactacgtacgtacgttacgtaagtaacgtacgtacgggttaccgttacgtaaccggtttaccggggacgggtaacgggaaccgtaacggggtaccggaaacccgtaaccgaaaccggtaccgtacggttacggtaccgtacggtaaccctaacctaacgttaccgttacgttaccttaccgtacgttaccccgtaccccggtaccgtacgtacccgg

SEQ ID NO: 5592 - DNA, 664 bp, Homo sapiens
  misc_feature: GYAE6OF02HL86B.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (658)..(658): a, c, t, g, unknown or other
  misc_feature (658)..(658): n is a, c, g, or t
tcagctcgcgtgtccacgaccggtgctcgatttagagctcacgtattgggtttgggggaggaactgctcagttaggacccagacggaaccatggaacgcccagcgcagcttctcttcctcctgctactctggctcccagagatcattggagaagtggtgatgacacagtctccggtcaccctgtcttgttttccgngggganagacgcccaccctctcctggtcgccggccagtcagagtcgttaggacgtaacttagcctggtatcagcagacgcctggccaggcctccagacctcctctattcgttggccttaccttaacggacgggacctaggtggaacctcccgagccgtaggttcaggccggctaggttcggtcgtgggtacctttcggtacacgtctaccaacgtatacctaaacgtaaccgtgaacctaacgttccgtacggtaaccgttaactttgaccgttaagtttttacttctacggttcaaggtcgtaagttcgtaaggaaacgtcgttacgggtcccgttacgtacccggtttcggggaccggggagggtaacccgtaagggtcccgaaccgtaacgaaaccgagttcggacggtccgtagcccactattccgttagttccttactacctttcccgtcccgactntaccgg

SEQ ID NO: 5593 - DNA, 518 bp, Homo sapiens
  misc_feature: GYAE6OF02FKBJ7.8.28.C06.1.454.CMB.1.raw
  modified_base (300)..(300): a, c, t, g, unknown or other
  misc_feature (300)..(300): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
  modified_base (515)..(515): a, c, t, g, unknown or other
  misc_feature (515)..(515): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcttggcncctttaacagggccagtggaactcccagccaggttcagcggcagtgggtctgggacttcgtcactctcaccatcaataacctgacaatctgacgactttgctagtttatttctgtcagcagtctgaagtactggccttcacgtttcggacggagggacctaagggtcgacctcaacgactgnggcngcaccntctgtcttcattcctcccgcctntcg

SEQ ID NO: 5594 - DNA, 645 bp, Homo sapiens
  misc_feature: GYAE6OF02I5NT3.8.28.C06.1.454.CMB.1.raw
  modified_base (196)..(196): a, c, t, g, unknown or other
  misc_feature (196)..(196): n is a, c, g, or t
  modified_base (336)..(336): a, c, t, g, unknown or other
  misc_feature (336)..(336): n is a, c, g, or t
  modified_base (457)..(457): a, c, t, g, unknown or other
  misc_feature (457)..(457): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccgnggggagagacgcccacccgttctccgtggtcgccggcctagtccgaaggtacggtaccggttaacggaccgtaaacgttcggccgttagggtactcgagcgaggacggccgtcggaccacggcctcccgagtacctcctntacttcgtttcggccgtaccttaacgacgggtccaggtacggaactcccgagtccgtaggttcgacggcggtcgtaggtcggtcgtcggtaccttcgtcacgtctacactatacaactacngactactctacgtacttacttcgtacttagtttactcgtctacgtgtactgtactagactcgtcggttacctcggtacgttacggacggtacggacgtacgtacgacgtaacgtacgtacgtgtacgtacgtcgtaccacgtcttacgttctcgttacctaccgttaccgtaccgtacgtacgtacgg

SEQ ID NO: 5595 - DNA, 538 bp, Homo sapiens
  misc_feature: GYAE6OF02F5EUU.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccacggttcagcggcagtgggtctgggacttcgtcactctcaccatcaaataacctgacaatctgacgtactttgctagtttatttctgtcagtcagtctagaagctggtccgttcacgtttcgggacgggtagggaccgtaagggtcggacctacgaaacgtacgtgtaggcgtgcaccatcgtgttcttcacttcctcccgcctatcg

SEQ ID NO: 5596 - DNA, 594 bp, Homo sapiens
  misc_feature: GYAE6OF02GR6V7.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcactcgtttcgggccgtaccctttaaacgacggggcccaggtacggaactccccgagcctagggttcacggccggcgaggtggggtcgtggggtactttcgttacactctcacctatacaaactaacctgactaatctagacgtactttgcttagtttacttctgtctagctagtctagaacgcgtcggtccgttcgtacgtttcgggacggtacgggaccgtaagggtcggaacctacgaacgtacgtgtacggctcgaccacctattcgtacgttcttctacttccctcccgtcctatcg

SEQ ID NO: 5597 - DNA, 587 bp, Homo sapiens
  misc_feature: GYAE6OF02H7X32.8.28.C06.1.454.CMB.1.raw
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacngggccagtggaactcccagccaggttcagcggcagtgggtctgggacttcgtcactctcaccatcaatacctgacaatctgactactttgctagtttattctgtcagctagttctagtaacgactcggtccgttctaccgtttcgggacgggtacgggtaccgaaagggttcggaacccttacgaaaccgtacgttaggtcggtcgttcggacctaaccctaagttccgtttacggttcctttacgtaactttcccgttaccctacgtccctaacg

SEQ ID NO: 5598 - DNA, 585 bp, Homo sapiens
  misc_feature: GYAE6OF02IWC69.8.28.C06.1.454.CMB.1.raw
  modified_base (194)..(194): a, c, t, g, unknown or other
  misc_feature (194)..(194): n is a, c, g, or t
  modified_base (448)..(448): a, c, t, g, unknown or other
  misc_feature (448)..(448): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagagccacctctcctgtgcggccagtcagagcgttaggacaacttagcctggtatcagcagacggcctggccaggcctcccagtacctcctcattcgttggccgtcctttaacgacgggtccaaggtcggaaactccccaaggccctaggttcaagcggcaggtgggtctggggtactttccggtttcacgttcctcacctatacaaactacctgactaatctagtaccgtactttgacttagttttnttctgtcagctagtctgaaagtctggcgttctacgttcggacgggtaggaccgaagggtcgaacctacgaacggtaacgtgtacggctcggacctacacttcgtacgttcttacaccttccttacccgtctacttcg

SEQ ID NO: 5599 - DNA, 531 bp, Homo sapiens
  misc_feature: GYAE6OF02FUXAW.8.28.C06.1.454.CMB.1.raw
  modified_base (444)..(444): a, c, t, g, unknown or other
  misc_feature (444)..(444): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccaggtggaactcccagccaggttcagcggcaggtgggtctgggacttcgttcactctcaccatcaataacctgcaatctgacgactttgctagtttattctgtcagcagtctgaagtactggccgttanacgtttcggcggtacggaccgaaggtcgacctacgaaacgacgtgtaggcgtcgacaccatctgtcttctacttcctcccgcactcg

SEQ ID NO: 5600 - DNA, 522 bp, Homo sapiens
  misc_feature: GYAE6OF02HJUKD.8.28.C06.1.454.CMB.1.raw
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactccncatctttggcncctttaacagggccagtggaactcccagccaggttcaggcggcagtgggtctgggacttcgttcactctcaccatcaatacctgacaatctgacgtactttgactagttttattctgtcagctagtctgaatctggccttctacgtttcgggcggagggacctaaggtcgactacgaaacgactgtggctgccacatcgtgtctcactccttccgctatcg

SEQ ID NO: 5601 - DNA, 540 bp, Homo sapiens
  misc_feature: GYAE6OF02JGFBU.8.28.C06.1.454.CMB.1.raw
  modified_base (311)..(311): a, c, t, g, unknown or other
  misc_feature (311)..(311): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacgngggccagtggaatcccagccaggttcagcggcagtgggtctgggacttcgtcactctcacatcaatacctgcaatctgacgtactttgctagtttatttctgtcagtcagttctagaacgtactggtccgttcgtacgtttcgggcggtaacgggaccgaaggtcggacctacgaaacgacgtgtcggctgaccaccatcgtgttccttcgacttccttcccgcatccg

SEQ ID NO: 5602 - DNA, 637 bp, Homo sapiens
  misc_feature: GYAE6OF02JBRFI.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaattagcctggtatcagcagaggcctggccaggctcccagactcctcatctttggcgcctttaacagggccagtggaatcccagccaggttcagcggcagtgggtctgggacttcgtcactctcaccatcaataaccctgacaatctgacgtactttgctagtttatttctgtcagctagtctagaagactcggccgttcgtaccgttttccgggacggtaacggggtaacccgtaagggttacgggtaacccgttaacgtaaaaccgggtaaccgttacgggttacgggtaccgttacggacccgtaacccgtaacgtttcccgttacggtttacccgttttcctaaaccgtttccccgttttaccccccggtacccctaacgtttaccccgg

SEQ ID NO: 5603 - DNA, 542 bp, Homo sapiens
  misc_feature: GYAE6OF02F13OZ.8.28.C06.1.454.CMB.1.raw
  modified_base (290)..(290): a, c, t, g, unknown or other
  misc_feature (290)..(290): n is a, c, g, or t
  modified_base (417)..(417): a, c, t, g, unknown or other
  misc_feature (417)..(417): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactccncatctttggcgtcctttaacgagggccaggtggaactcccagccaggttcaggcgcaggtgggtctgggacttcgtcactctcaccatcaatacctgcaatctgacgtactttgctagtttacttcngtcagctagtctagaagtctgggccgttcacgtttcgggacggtacggaaccgtaggtcgacctacgtaaacgacgtgtaggctcgacacctacttctgtcttacacttcctccccgtctatccg

SEQ ID NO: 5604 - DNA, 519 bp, Homo sapiens
  misc_feature: GYAE6OF02FT1PN.8.28.C06.1.454.CMB.1.raw
  modified_base (493)..(493): a, c, t, g, unknown or other
  misc_feature (493)..(493): n is a, c, g, or t
  modified_base (515)..(515): a, c, t, g, unknown or other
  misc_feature (515)..(515): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttattctgtcagcagtctgaagactggccgttcacgtttcgggcggtagggaccaagggtcggacctcgaaacgactgtggctgcaccntcctgtcttcactcttcccgcntccg

SEQ ID NO: 5605 - DNA, 613 bp, Homo sapiens
  misc_feature: GYAE6OF02IZ18M.8.28.C06.1.454.CMB.1.raw
  modified_base (166)..(166): a, c, t, g, unknown or other
  misc_feature (166)..(166): n is a, c, g, or t
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
  modified_base (477)..(477): a, c, t, g, unknown or other
  misc_feature (477)..(477): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacanagtctccggtcaccctgtctgttttccngggganagagccacctctcctgtgcggccagtcagagcgttaggacgtaacttagcctggtatcagcagnggcctggccaggcctaccagactcctcatctttggcctccttaaacgcgggctagtcggaactcccgagccctaggttcagcggtcaggtcggggtctggggtactttcgtcgtactctacacccataccaaacttacctgacctaatcgtagtaacgtactttcgcttagttttatttcagtcagctagtctagaacgtctgggtcccttanacgtttcgggcgggaacggtaccgtaagggtccggaaccttaccgaaaacgttacgtacgggtcggtcctcggacctaccgtaattccgttaacgttcttaccgtaacgtttccccttaccggaccctaagttccg

SEQ ID NO: 5606 - DNA, 619 bp, Homo sapiens
  misc_feature: GYAE6OF02FGCZL.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagacctcctcatctttggcgtcctttaataggccagtggaactcccagccaggttcagcggcaggtgggtctgggacttcgtcactctcaccatcaatacctgacaatcagactactttgctagttttattctgtcagcagttctagaacgtactcgggtcccgtttacaccgttttcggggaccgggaacggggtaaccctaaggggtcgaacccgttacgaaaacccggtaacgttcgggtacgggccttacgggaccctaacccgtaagtttcccgttacggtttccctttaccaccgttttccccgtttacccccggtacccttacttacccg

SEQ ID NO: 5607 - DNA, 513 bp, Homo sapiens
  misc_feature: GYAE6OF02GLA3R.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttcactttcggcggagggaccaagggtcgacctcaacgactgtggctgcaccatctgtcttcattcctcccgcatcg

SEQ ID NO: 5608 - DNA, 516 bp, Homo sapiens
  misc_feature: GYAE6OF02HPAEG.8.28.C06.1.454.CMB.1.raw
  modified_base (511)..(511): a, c, t, g, unknown or other
  misc_feature (511)..(511): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacgagggccagtggaatcccagccaggttcagcgcaggtggtctgggacttcgtcactctcaccatcaatacctgacaatctgacgtactttgctagtttattctgtcagtcagtctgaagtctggccttcacgtttcggcggagggaccgaagggtcggacctacgaacgactgtggctgcacatctgtcttcattcctccncatcg

SEQ ID NO: 5609 - DNA, 552 bp, Homo sapiens
  misc_feature: GYAE6OF02HWRRF.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagagcctggccaggctcccagactcctcatctttggccgtcctttaacgagggccagtggaatcccagccaggttcagcggcagtgggtctgggacttcgtcactctcaccatcaataacctgacaatctagacgtactttgctagttttattctgtcagtctagttctagaagtactgggtcccgtttctacgtttcgggacgggtacgggaccgtaagggtcggaacctacgaaacgtacgtggtcggctgaccactatcctagttcttcacttccttcccgctatcg

SEQ ID NO: 5610 - DNA, 686 bp, Homo sapiens
  misc_feature: GYAE6OF02HKC0Q.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggcctcccagactcctcattcgtttggccgtcctttaacgacggggtccaggttcgggaaacttccccgaaggcccgtaaggttccaagggccgggacgagggttggggtaccgtgggggtacttttccggttaccacgttctaccaacctagttaccaaacttaaacccgttgacctaaacttccgttacgaaccgttacttttcgtacttaagttttactttctgttacagtactagttctaggaaagtaccgtcgggtcccgtttacgtaccgtttcggggaccgggtaagggtaacccgtaagggtcggtaaccctacgaaaccgtaccgttggtacgggtacgtcggaccctacgtacgttccgttagttaccttactacgtttcccgttacccgtcctattccg

SEQ ID NO: 5611 - DNA, 514 bp, Homo sapiens
  misc_feature: GYAE6OF02GNTSD.8.28.C06.1.454.CMB.1.raw
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccagtggaatcccagccaggttcagcggcagtgggtctgggacttcgtcactctcaccatcaataacctgacaatctgacgactttgctagtttattctgtcagcagtctgaagactggccgttcacgtttcggcggagggaccaagggtcggacctcgaacgactgtggctgcacatctgtcttcatccttccgctatcg

SEQ ID NO: 5612 - DNA, 570 bp, Homo sapiens
  misc_feature: GYAE6OF02JAQVO.8.28.C06.1.454.CMB.1.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttgcctggtatcagcagacggcctggccaggcctccccagactcctcattctttggccgtcctttaaacgcggggccaggtcggaactccccgaagcccgtaggttccaggtcggcgaggtggggtctgggtacttcgttcacgtctcacctatcaaatacctgcaatctagactactttgactagttttactttcgtgtcagtctagtctgaagtctggtccttcgtacgtttcggacggtagggtaccgaagggtcgaacctacgaacgaactgtacggcgtcgaccactatcttcgtcttctactccttcccgcctatacg

SEQ ID NO: 5613 - DNA, 564 bp, Homo sapiens
  misc_feature: GYAE6OF02GYRS6.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagagcccaccctctcctgtgcggccagtcagagcgttaggacgaacttagcctggtatcagcagaggctggccaggctcccagactcctcatcttcggctcctttaacgagggccagtggaactccagccaggttcaggcgcagtgggtctgggacttcgttcactctcaccatacaataacctgacaatctagacgtactttgactagtttattctagtcagctagtctagaatcgtggtccgttctacgtttcgggcggtaacgggaccgtaagggtcggtacctaacgaaacgtaacgtggtcggcgtcggacaaccgtatacctggttaccttcacttccttcccgacctacttccg

SEQ ID NO: 5614 - DNA, 538 bp, Homo sapiens
  misc_feature: GYAE6OF02G6E0U.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaatcccagccaggttcaggcgcagtgggtctgggacttcgtcactctcacatcaatacctgacaatctgacgtacttgctagtttattctgtcagctagtctgaacgctggtccgttctacgtttcggcgaggaccaaggtcggacctacgaaacgactgtcggctcgaccacctatccgttgttccttacgtacttccgttacccgtccagttccg

SEQ ID NO: 5615 - DNA, 607 bp, Homo sapiens
  misc_feature: GYAE6OF02JSU9U.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagngcgttaggacgaacttagcctggtatcagcagaggcctggccaggcctcccgagacctcctcattccgtttggccgtacctttaacgaggggtcccaaggtggaactccccgagtccgaaggttcaggcggcaggtcgggtctgggactttcggttcactcgtacacctatactaactactgactaatcctagaacgttactttgacttagttttacttctagtccagtctagttcctagaacgtcgtacggtcccttactacgtttcgggacggtacgggacctaagggttccgaacctacgaaacgtactggtcggacgtcgacctaacctagttcgtacgttcctacgtaccttcccgtacccgtctactcg

SEQ ID NO: 5616 - DNA, 875 bp, Homo sapiens
  misc_feature: GYAE6OF02HPW43.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtcgcggccagtcagacgtcgttaggacgtaacttacgcctaggtactcagcaggacggccgtcggaccgacggcctacccaaggtacctcccgtactagttccgtttcgggaccgttaccgtttaaacgacggggtccctaaggtacggaaacgttcccgaagaccgtaacggttacaacggtaccggtacgtaggttcgggtaccgttaggggtacctttaccggtttaccaacgttcctaccgtaacctaacttacctaaaacgttaaacccgtgaacctaagttaccgttacggtaaaccgttaccgttttcggtacccttaaggtttttaactttaccgttacggttaccgtaacggttaccgtacggttacgttaacgggtaaacgtaccggtttccgggttacccgttttaacgttaacccggtttttccggggaaccggggtaaacggggtaacccgttaaacgggggttaccggtaaaccccttaaaccggtaaaacccggttaaccggttagggttaacccgggtaacccggttccggtaaccccgtaaacccgggttaacggttacccgtttaaccccgggtttacctttaacccggtaacccgttttacccccggtttacccccgtaccgttaacccgtttacccgg

SEQ ID NO: 5617 - DNA, 549 bp, Homo sapiens
  misc_feature: GYAE6OF02FF5EB.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacaggccagtggaatcccagccaggttcagcggcagtgggtctgggacttcgtcactctcaccatcaatacctgacaatctgacgtactttgctagtttatttctgtcagcagtctagaagtactggtccgtttcacgttttcgggcggtacgggaccgtaagggtcgaccgtacgaaacgaacgttggtacggcgttcgcctaccgtattccgtgttcttcacttccttccccgctactcg

SEQ ID NO: 5618 - DNA, 535 bp, Homo sapiens
  misc_feature: GYAE6OF02HW608.8.28.C06.1.454.CMB.1.raw
  modified_base (202)..(202): a, c, t, g, unknown or other
  misc_feature (202)..(202): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagagcctggccaggctcccagactcctcatctttggcgtcctttaacgagggccagtggaactcccagccaggttcagcggcagtgggtctgggacttcgttcactctcaccatcaataacctgacaatctagacgtactttgctagtttattctgtcagtcagtctgaagtactggtccgttctacgtttcggcggaagggaccgtaaggtcggacctacgaaacgaactgtagcgtgccacatctgttcttcacttccgttcccacatcg

SEQ ID NO: 5619 - DNA, 624 bp, Homo sapiens
  misc_feature: GYAE6OF02I2MG9.8.28.C06.1.454.CMB.1.raw
  modified_base (318)..(318): a, c, t, g, unknown or other
  misc_feature (318)..(318): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcatcctttggccgtccttttaaacgnggggccaggtcggaactcccagccaggttcaggcggcaggtcgggtctggggaccttcgtcactctacaccatcaaatacctgacaatctagtacgtacttttgacttagttttactttctcgtcagtcgtagttctaggaaacgtaccgttcgggtcccgtttactaccggttttccgggacgggtaacggggaacccgtaagggtccggtaacctaacgaaacgtaacgttcggtacggtcgtcggaccaaccgtagttccttgttacctttccaacgttcccgttaccccgtacctcttaccg

SEQ ID NO: 5620 - DNA, 568 bp, Homo sapiens
  misc_feature: GYAE6OF02GES0A.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccaggcccctcatctatggtgcatccaacagggccactggcatcccagccaggttcagtggcaggtgggtatgggacagacttcactctcaccatcatcagcctggacgcctggaggtatgttgcttagtttacttacgtcgtacaactagtaccgtacgtaggtcggccggtccggggtaccttaccgttcccggccgtacgggaaccgtaaggtacggtaatacgtaacgaaacggtaacgttggtacggtcgtacggaccacctacgtccgttacgttccttacc

SEQ ID NO: 5621 - DNA, 533 bp, Homo sapiens
  misc_feature: GYAE6OF02FT0Q1.8.28.C06.1.454.CMB.1.raw
  modified_base (507)..(507): a, c, t, g, unknown or other
  misc_feature (507)..(507): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacgagggccagtggaactcccagccaggttcagtggcaggtgggtctgggacttcgtcactctcaccatcaatacctgacaatctgacgtactttgctagtttattctgtcagcagttctagaagtctggtcccgtttctacgtttcgggcgggtacgggaccgaagggtcgacctacgaaacgactgtggctcgccacntctgtcttcacttcctcccgctatcg

SEQ ID NO: 5622 - DNA, 558 bp, Homo sapiens
  misc_feature: GYAE6OF02JF70B.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatcttggctcctttaacngggccagtcggaactcccagccaggttcaggcggcaggtgggtctgggacttcgtcactctcaccatcaatacctgacaatctagacgactttgctagtttattctgtcagtctagtctagaacgtactcggtccttactacgtttcggacgggtacggaccgtaagggtcgtaccgtacgaacgtaactggtacggcgtcggaccacgtactcgtgttcttacgacgttccttacccgactacttacg

SEQ ID NO: 5623 - DNA, 558 bp, Homo sapiens
  misc_feature: GYAE6OF02HJ317.8.28.C06.1.454.CMB.1.raw
  modified_base (194)..(194): a, c, t, g, unknown or other
  misc_feature (194)..(194): n is a, c, g, or t
  modified_base (522)..(522): a, c, t, g, unknown or other
  misc_feature (522)..(522): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggcctcccagacctcctcattctttggccgtcctttaacgagggccaggtggaactcccagccaggttcagcggcaggtgggtctgggacttcggttcactctcaccatcaatacctgacaatctgacgtactttgcttagtttactttctgtctagtctagttctaggaagtacgtcggtccgttctacgttcggcgggacggtacgagggtacggacctacgaacgtacgtgtcggcgtgccactntcgttgtccttactaccttccgttacccgcctatcg

SEQ ID NO: 5624 - DNA, 582 bp, Homo sapiens
  misc_feature: GYAE6OF02FEG6F.8.28.C06.1.454.CMB.1.raw
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
  modified_base (386)..(386): a, c, t, g, unknown or other
  misc_feature (386)..(386): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcattctttggcncctttaacgagggccagtcggaactcccagccaggttcagcggcagtggtctgggactttcgtcactctcaccatcaataaccngacaatctgacgactttgctagttttactttctgtcagcagttctagaacgtactggcccgtttcgacgttttcgggacgggtaagggaaccgaagggttcgaaccctacgaaaccgtaacgttggtacggcgtcgaccaacccgtattccgttcggtacctttccgtaacttccctttccccggacctagttccg

SEQ ID NO: 5625 - DNA, 571 bp, Homo sapiens
  misc_feature: GYAE6OF02H5PQW.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcctttggcgtcctttaacgagggccaggtggaactccccgagcctaggttccaggcggcaggtcgggtctgggactttcgtcactctcaccatcaatacctgcaatctgacgtactttgacttagtttattctgtcagctagtctagaagtcgtcggtccgttctacgtttcgggacgggaacgggtaccgtaagggtcggaaccctacgaaaccgacgttggtaggccgtgacctaaccgacttcgtcgttcttcaccttcccttcccgcctatccg

SEQ ID NO: 5626 - DNA, 560 bp, Homo sapiens
  misc_feature: GYAE6OF02H4ZRL.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaattagcctggtatcagcagaggcctggccaggctcccagactcctcatctttggcgtcctttaacagggtccagtggaactcccagccaggttcagcggcagtgggtctgggacttcgtcactctcacctatcaataacctgactaatctgacgtactttgctagtttactttctgttcagtctagttctagaagtcgtacggtccgtttcgtacgttttcgggacgggtacgggaccgtaagggtcggacctacgaaacgactggtcggcgtgaccacacttctacgttcttacacttcctcccgtcctattccg

SEQ ID NO: 5627 - DNA, 535 bp, Homo sapiens
  misc_feature: GYAE6OF02F0J8B.8.28.C06.1.454.CMB.1.raw
  modified_base (309)..(309): a, c, t, g, unknown or other
  misc_feature (309)..(309): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcttggcgcctttaacngggccagtggaatcccagccaggttcagcggcagtgggtctgggacttcgtcactctcaccatcaataacctgacaatctagacgtactttgctagtttatttctgtcagctagtctgaagtactggtccgttcacgtttcgggcgggtagggaccgtaagggtcggaacctacgaaacgtaactggtggctgccacatctgttcttctactccttcccgctatcg

SEQ ID NO: 5628 - DNA, 561 bp, Homo sapiens
  misc_feature: GYAE6OF02G2TVB.8.28.C06.1.454.CMB.1.raw
  modified_base (309)..(309): a, c, t, g, unknown or other
  misc_feature (309)..(309): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcttggcgcctttaacngggccagtggaatcccagccaggttcagcgcagtgggtctgggacttcgttcactcgtcaccatcgaataacctgctaatctagacgtactttgctagtttattctgtcagtcagtcgtgaacgtcgtcggtccgttctacgtttcgggacgggtacgggaccgtaagggtcggacccgttacgaaacgtacgtggtaggaccgtggaccaccgtagtacttcgtcttctacttccgttccccgctattccg

SEQ ID NO: 5629 - DNA, 585 bp, Homo sapiens
  misc_feature: GYAE6OF02IP5GK.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggcctcccagacctcctcatctttggcgtacctttaacgagggccagtggaactcccgagccaggttcagcggcaggtgggtctgggacttcgttcactctcacctatcaataacctgacaatctgacgtacttgctagtttatttctgtcagctagttctagaagtacgtcggtccgtttcgtacgttttcgggacgggtacgggaccgtaagggtcggtaacccgtaacgaaacggtaacgtggtacggtcgtacgccaacctagttccgtgttccttaccgtacttcccgtcccgtacctacttaccg

SEQ ID NO: 5630 - DNA, 996 bp, Homo sapiens
  misc_feature: GYAE6OF02HVU3R.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgtcttgtttttccgnggggagagacgccaccctctcctgtgcggccagtcaggagcggttaggacgtaacttagcctggtatcagcaggaggcctggccaggcctccagtacctccctcacttccgtttggccgttacctttaaacgacggggtccctaggtcggaaactccccgaaggcccgtaacgggtttccaagggtccgggacgtacgggttcgggggttaccgttcggggggttaaccttttccgggttttaccaaccgtttccctttacccgaaacccctaaactttaaccgtaaaaaacccgtttaaacccgtttacggtaaacccttaaaacgtttacccggtttaacgggtaaaccccgggttttaacgttttttaccggtaccgtttttaaacgggttttttttaaacgttttccggtttaccgggtttaaccgtaacggttaccgttaaacgggttttacccgttaaaggggtaaaaccggttaccggtttaccggggttaccccggttttaaccggtttaacccgggtttttaccgggggaacccgggggtaaaccggggtaaaccccgggttaaacgggggtttacccgggtaaaaccccgttaaaccgggttaaaaaacccggtaaccgggtttacggggtttaaccggggtacccgtttaaccgggtaacccccggttaaacccgttaaccggttttacccgtttaccgggtttttacccctttaacccggttaacccgtttttacccccccgggttttaccccccgggtaacccttaacccggttttaaccccggg

SEQ ID NO: 5631 - DNA, 697 bp, Homo sapiens
  misc_feature: GYAE6OF02H6A6R.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccacctctcctgtgcggccagtcagagcgttaggacgtaacttagcctggtatcagcagaggcctggccaggctcccagactcctcatctttggccgtacccttttaaacgacgggtccctaaggtcgggtaaacttccccgaaggcccgtaagggttccaggccggcgtaggtcggggttcgtggggtactttcggttccaacgttccgtcaaccctatacctaaacttaaacctgacctaaagttcgtacgtaaccgttacttttacgcgttaagttttactttccgttagttactacgtcgtagttcgtaaggtaacgtacgtacgggttcccgtttacgtaaccggttttccgggaccgggtaacggggtaacccgtaagggttccgggaaccttaacgaaaaccgtaacgtcggttacggtaccggtgaccctacgaactttcgtcgttcttaccgtactttaccctttccccgtacccactttccg

SEQ ID NO: 5632 - DNA, 539 bp, Homo sapiens
  misc_feature: GYAE6OF02G3AD7.8.28.C06.1.454.CMB.1.raw
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcttggcncctttaacngggccagtggaatcccagccaggttcagcggcaggtgggtctggggacttcgttcacgtctcaccatcaataacctgcaatctgacgactttgactagtttattctgtcagctagtctagaagtactcggtccgttcgtacgtttcgggcgggtaacgggaccgtaagggtcggacctacgaaacgactggtggctcgccacgatctgttctcattcctcccgactatcg

SEQ ID NO: 5633 - DNA, 534 bp, Homo sapiens
  misc_feature: GYAE6OF02FWUZ4.8.28.C06.1.454.CMB.1.raw
  modified_base (195)..(195): a, c, t, g, unknown or other
  misc_feature (195)..(195): n is a, c, g, or t
  modified_base (371)..(371): a, c, t, g, unknown or other
  misc_feature (371)..(371): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgcctttaacaggccagtggaatcccagccaggttcagcggcagtgggtctgggacttcgtcactctcaccntcaataacctgacaatctgacgactttgctagtttattctgtcagcagtctgaagtctgccgttcacgtttcggcggacggacgaaggtcggaacctcgaaacgactgtacggcgtcgccaccgattcgtacggttcttctacttccgttccccgcctatccg

SEQ ID NO: 5634 - DNA, 596 bp, Homo sapiens
  misc_feature: GYAE6OF02IQF3C.8.28.C06.1.454.CMB.1.raw
tcagctcgcgtgtccacgaccggtgctcgatttagagctcacgtattggggtttgggggaggaactgctcagttaggacccagacggaaccatggaagccccagcgcagcttctcttcctcctgctactctggcctcccagagatcattggagaagtggtgatgacacagtctccggtcaccctgtcttgtttttccgtggggagagacgcccaccctctcctgtcgcggccagtcagagtcgttaggacgtaacttgcctggtatcagcagaggcctggccaggcctcccagacctcctcattcttggccgtcctttaacgacgggccaggtcggaactcccgagcctaggttcagcggctaggtgggtctggggacttcgttcacgttctcaccatacaactacctgactatctgaactactttgcttagtttactttctgtcagtctagttctagaacgtctgggtccttcgtacgttcgggacggtacgggaccgtaagggtcggaccttaacgaacgtacgtggtcggtcgtcgtaccacgtacttacgttagttacttacctacgttcccttacccgtacctacttccgg

SEQ ID NO: 5635 - DNA, 586 bp, Homo sapiens
  misc_feature: GYAE6OF02I17DX.8.28.C06.1.454.CMB.1.raw
  modified_base (428)..(428): a, c, t, g, unknown or other
  misc_feature (428)..(428): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccagactcctcattcttggcgtcctttaacgacgggtccaggtcggaaacttcccgaaggcctaggttccagccgggcaggtgggtctggggacctttcggttcacttctccaccatccaataaccctgactaatctagtactactttncgttagttttatttcgtgtactagctagttctagaacgtctacgggtcccgttcgtaccgtttcgggacgggtagggaccgtaagggttcggacctaacgaaacgtacgtggtacggctggccaccattcttagtcttcacttcctcccgtcctatcg

SEQ ID NO: 5636 - DNA, 518 bp, Homo sapiens
  misc_feature: GYAE6OF02IW3XB.8.28.C06.1.454.CMB.1.raw
  modified_base (201)..(201): a, c, t, g, unknown or other
  misc_feature (201)..(201): n is a, c, g, or t
  modified_base (492)..(492): a, c, t, g, unknown or other
  misc_feature (492)..(492): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgcctttaacagggccagtggaatcccagccaggttcagcgcagtgggctgggacttcgttcactctcaccatcaatacctgcatctgacgactttgactagtttattctgtcagcagttctagaagactggccgttctacgtttcggcggagggaccgtaaggtcgacctcgaaacgactcgtgcgtgcacntctgtcttctactcttcccgctatcg

SEQ ID NO: 5637 - DNA, 561 bp, Homo sapiens
  misc_feature: GYAE6OF02JKX9G.8.28.C06.1.454.CMB.1.raw
  modified_base (194)..(194): a, c, t, g, unknown or other
  misc_feature (194)..(194): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagagcccaccctctcctgtgcggccagtcagagcgttaggacgaacttgcctggtatcagcagagcctggccaggctcccagacctcctcatcttggcctcctttaacgaggccagtggaactcccagccaggttcaggcgcaggtcgggctgggtacttcgttcactctacacatcaaatacctgactaatctnacgtactttnctagtttatttctgtacagctagtactgaaacgtcgtcggtccgtttcacgtttccgggacggacgggaccgtaagggttcggaacctacgtaaacggacttggtcgcgtcgacaccgtatcgtgtccttcgtaccttccttacccgcctagtccg

SEQ ID NO: 5638 - DNA, 517 bp, Homo sapiens
  misc_feature: GYAE6OF02GQUB3.8.28.C06.1.454.CMB.1.raw
  modified_base (201)..(201): a, c, t, g, unknown or other
  misc_feature (201)..(201): n is a, c, g, or t
  modified_base (474)..(474): a, c, t, g, unknown or other
  misc_feature (474)..(474): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaaataacctgcaatctgacgactttgctagtttattctgtcagtcagtctgaagtactggccgttcacgtttcgggcggagggaccaaggtcggacctnaaacgtactgtggctgccacatctgtcttcatcctcccgcatc

SEQ ID NO: 5639 - DNA, 628 bp, Homo sapiens
  misc_feature: GYAE6OF02JIKV6.8.28.C06.1.454.CMB.1.raw
  modified_base (196)..(196): a, c, t, g, unknown or other
  misc_feature (196)..(196): n is a, c, g, or t
  modified_base (343)..(343): a, c, t, g, unknown or other
  misc_feature (343)..(343): n is a, c, g, or t
  modified_base (600)..(600): a, c, t, g, unknown or other
  misc_feature (600)..(600): n is a, c, g, or t
  modified_base (607)..(607): a, c, t, g, unknown or other
  misc_feature (607)..(607): n is a, c, g, or t
  modified_base (623)..(623): a, c, t, g, unknown or other
  misc_feature (623)..(623): n is a, c, g, or t
tcagctcgcgtgtccacgaccggtgctcgatttagagctcacgtattgggtttggggagggaactgctcagttaggacccagacggaaccatggaagccccagcgcagcttctcttcctcctgctactctggctcccgagagatcattggagaagtggtgatgacacagtctaccggtcacctgtctgttttccgnggggatagacgaccacctcgtccgtggtcgccggccagtccgagacggccgttaaggacgtaacttacgcctggtatcgagccaggacgcctcggaccaggcctcccgagacctccgtacacgttcgttcggcctaccgtttaacgngggtccctaggtcggaactccccgagaccgtacggttcagccgggtacaggtcgggtcgtaggggtacctttcgggtacacgtctaccgtaactattaccaaaagttccctgacctaacttccgtaggaccttacgttggtacttagtttattcgtagtcagtctatactgaacgtcgtcggtcctctacgttcggacgggacgtacgagggttcgaccttaacgacgtacgtgcgactcggacaacgttccgttanccgttanaccttccgtccacgtntaccg

SEQ ID NO: 5640 - DNA, 852 bp, Homo sapiens
  misc_feature: GYAE6OF02G02H2.8.28.C06.1.454.CMB.1.raw
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcagttggagaagtggtagatgacacagtcgtccggtccacctgtcttcgttttccgngggagagacgcccacctctcctgtcgcgccagtcagagtcgttaggacgtaacttacgccgtaggtactcgagcgaggacggccgtcggccacggcctacccgagtaccctcctactacttcgtttcgggcccgttaccgtttaacggacgggtacccgtaggtacggtaacctaccccgacggtccgtacggttacgacgggccggacgtagggttcggggtacggttacgggtacctttccggtttaccgtaccgttaccttaccaaacccgttactaaccgtaaaacctttaacccgtacgtaaccttaaactccgttaacggtaaccgtttaccgttttcggtaacgttttaagttttactttacgttacgttaccgtaaggttaccgttacgttaccgttaggtaaaaccgttccggtttaccgggtacccgtttaccgttacccgggttttaccgggggaaccggggtaacccgggtaaccggttaacggggttaccgggtaaacccgttaacccggaaaaccgggtaaccggttacgggttacggtaccgttccggaacccgttaacccgtacgttacccggtttacgtttacccttaacccgttaccgtttacccccggtaccccgttaaccgtccgttaccgg

SEQ ID NO: 5641 - DNA, 517 bp, Homo sapiens
  misc_feature: GYAE6OF02FVU28.8.28.C06.1.454.CMB.1.raw
  modified_base (310)..(310): a, c, t, g, unknown or other
  misc_feature (310)..(310): n is a, c, g, or t
  modified_base (490)..(490): a, c, t, g, unknown or other
  misc_feature (490)..(490): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacnggccagtggaatcccagccaggttcagcggcagtgggtctgggacttcgtcactctcaccatcaatacctgcaatctgacgactttgctagtttattctgtcagcagtctgaagctggccttcacgtttcggcggaggaccaagggtcgacctacgaaacgtactgtacggctgcacctntctgtcttcattccttcccgctatccg

SEQ ID NO: 5642 - DNA, 607 bp, Homo sapiens
  misc_feature: GYAE6OF02GI4WV.8.28.C06.1.454.CMB.1.raw
  modified_base (196)..(196): a, c, t, g, unknown or other
  misc_feature (196)..(196): n is a, c, g, or t
  modified_base (321)..(321): a, c, t, g, unknown or other
  misc_feature (321)..(321): n is a, c, g, or t
  modified_base (391)..(391): a, c, t, g, unknown or other
  misc_feature (391)..(391): n is a, c, g, or t
  modified_base (405)..(405): a, c, t, g, unknown or other
  misc_feature (405)..(405): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagacgccaccctctcctgtcgcggccagtcagagcgttaggacgaacttagcctggtatcagcagaggcctggccaggcctcccagacctcctacattctttgggcctacctttaacgngggaccaggtacggaactcccgagccgtaggttcaggcggctaggtgggtcgtgggtacttcgtcactcncacatacaataccnacatcagaactactttgacttagtttattcgtagtcagtctagttctagaacgtcgtcggaccgtttacgacggtttccgggacgggtaacggtaaccgaggtacggtaacctaagaaaccggtactcggtaggccgttagacctaacctaagtccgttagttacccgttacttaccgttccctccccggtactacgtaccg

SEQ ID NO: 5643 - DNA, 567 bp, Homo sapiens
  misc_feature: GYAE6OF02GD5EA.8.28.C06.1.454.CMB.1.raw
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcacagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccagtggaatccagccaggttcagcggcagtgggtctgggacttcgtcactctcaccatcaataacctgacatctgacgtactttgcttagtttacttctgtcagtctagttctagaacgactcgggtcccgtttcgtaccgttttccgggacgggtacgggtaccgtaaagggtcggaaccctacgaaacgtacgttgacggtctcggaccaacctagttctagttccttcacttcccttccccgctactccg

SEQ ID NO: 5644 - DNA, 537 bp, Homo sapiens
  misc_feature: GYAE6OF02HUV0H.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (302)..(302): a, c, t, g, unknown or other
  misc_feature (302)..(302): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (529)..(529): a, c, t, g, unknown or other
  misc_feature (529)..(529): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagngcgttaggacaacttagcctggtatcagcagagctggccaggctccagctctcatcttggctccgttaacncggccagtcggaactccagcgagtcagcggcaggtcgggtctgggtacttcggttcactctcactatacaaactacngacactctcgactctttnctagtttacttcngtangctagtctagtacgtactggtccgttctacgtttcggacggtacggacgtaaggtcggactacgtaaacgacgtgtacggctgaccacacttactcgttacttcacgttcctccncctatcgg

SEQ ID NO: 5645 - DNA, 579 bp, Homo sapiens
  misc_feature: GYAE6OF02F7GYY.8.28.C06.1.454.CMB.1.raw
  modified_base (314)..(314): a, c, t, g, unknown or other
  misc_feature (314)..(314): n is a, c, g, or t
  modified_base (374)..(374): a, c, t, g, unknown or other
  misc_feature (374)..(374): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcattctttggcgtcctttaacngggccaggtggaactcccagccaggttcaggcggcaggtggtcgtgggcttcgtcactcncacatcaataccngacatctanacgtacttgactagtttattctgtctagtctagttctagaacgtacgttcggtccgtttcgtacgtttcgggacgggacgggtaaccgaagggtacggacctaacgaaaccgacgttggtacggtacgtcgaccactacgttcctaggttccttactaccgttccgtaccccgtacctatccg

SEQ ID NO: 5646 - DNA, 534 bp, Homo sapiens
  misc_feature: GYAE6OF02H7GWJ.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (434)..(434): a, c, t, g, unknown or other
  misc_feature (434)..(434): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaattagcctggtatcagcagaggcctggccaggcctcccagactcctcattctttggcgtcctttaacgagggtccagtggaactcccagccaggttcagcggcaggtggtctgggactttcgttcactctccacatccaaatacctgacaatctcgtacgtactttgctagtttattctgtcagctagtntagaagctggcttacgtacgttcggcggaggacgaaggtcggactacgaacgacgtgtcggctgaccactatctgtcttacgacttcctccgcctatccg

SEQ ID NO: 5647 - DNA, 660 bp, Homo sapiens
  misc_feature: GYAE6OF02IC1Q8.8.28.C06.1.454.CMB.1.raw
tcagctcgcgtgtccacgaccggtgctcgatttagagctcacgtattgggtttgggggagggaactgctcagttaggacccagacggaaccatggaagccccagcgcagcttctcttcctcctgctactctggctcccagagatcattggagaagtggtgatgacacagtctccggtcaccctgtcttgtttttccgtggggagaggagccaccctctcctgtgcggccagtcagagccgttaggacgaacttagcctggtatcagcagaggcctggccaggcctcccagacctcctcattcgtttggccgtcctttaacgcggccaggtcggaactcccgaagccctaagggttcaggcggcaggttggggtctgggtacctttcgttcactctacactataccgaaactaacctgacaattctagtacgtaactttgacttattttacttctgttcacgtctacgtctaggaacgtacgtcgggtaccgtttctaccggtttaccgggaccgggtacgggtaacccgtaagggttaccggaaccgttaccgaaaacgttaaccgtggtacgggtccgtacggtaccgaccccgttaagttccgttaacgtttccctttacgtaccgtttcccgttacccccgtacccgtagttcccgg

SEQ ID NO: 5648 - DNA, 563 bp, Homo sapiens
  misc_feature: GYAE6OF02H08U2.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacgacgggccaggtcggaactcccagcctaggttcaggcggcaggtgggtctgggacttcgtcactctcacatcaatacctgactaatctagacgtactttgcttagtttacttctgtcagtctagtctagaacgtcgtcggtccgttactacgtttcgggacgggtacgggaccgtaagggtcggaaccgtacgaaacgtacgtggtcggcgtcgcctactatctcgtcttctacttccgttcccgctactacg

SEQ ID NO: 5649 - DNA, 542 bp, Homo sapiens
  misc_feature: GYAE6OF02HYBC3.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacaggccagtggaatccagccaggttcagcgcagtgggtctgggacttcgttcactctcaccatcaataacctgacaatctagacgtactttgctagtttatttctgtcagcagtctagaagtactggtccgttctacgtttcggcggtacgggacgtaaggtcggacctacgaaacgactgtcggtcgtgccaccagttacctgttcttcaacttcccttcccgcctagtccg

SEQ ID NO: 5650 - DNA, 516 bp, Homo sapiens
  misc_feature: GYAE6OF02HA7LN.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttcactttcggcggagggaccgaaggtggaccctgaaaccgaactgtggctgcaccatctgtcttcatcctccgccatc

SEQ ID NO: 5651 - DNA, 681 bp, Homo sapiens
  misc_feature: GYAE6OF02IEAZG.8.28.C06.1.454.CMB.1.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
tcagctcgcgtgtccacgaccggtgctcgatttagagctcacgtattgggggtttgggggaggaactgctcagttagggacccagacggaaccatgggaagccccagcggcccagcttctcttcctccgtgcctactctggctcccagacggatcattggagaagtggtgatgacacagtcctccggtcaccctgtccttgttttccngggganagtacgccaccgtctcctgtcgcggccagtcagagtcggttacggacgtaacttagcctggtatcgagactagtaggtcctggccaggacctaccgaggacctcctcattccgttggcctacctttaagcgggtccagtcggtaactccgagccgtaggttccgaggcgcgtaggtgggtctaggggtacttcggttcacttcgtacgaaccctatacctaaactacctcgactaactctacgaccgttactttcgacttacgttttacgttcgttaggtacgtagtaccgttagttaccgttaggtaaacgtcgtacggttaccgtttccggttaaccggtttcggggaccggtaccggtacgtacgggttccgggaacctaccgaaacgtcgtaggtcgtacgtacggacctaccgtgttccgttcgttccttacggtaccttcccgtacccgtcgtacttaccg

SEQ ID NO: 5652 - DNA, 728 bp, Homo sapiens
  misc_feature: GYAE6OF02H6ZW2.8.28.C06.1.454.CMB.1.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaacgtgctcagttaggacccagacggaaccatggaagcccagcgcagcttctcttcctcctgctactctggctcccagagatcattggagaagtggtgatgacacagtctccggtcaccctgtcttgttttcctgggganagagccaccctctcctgtcgcggccagtcagagtaggttaggaacgtaacttagcctggtatcagcagacggctggccaggctccacgactctcatcgtttggcctaccgttaacacgggcctacggtggaaactccccgaagccgtaacgggttcacggcggactaggtcggggtctggggacctttcgttacgactctacaaccattacaaactaaccgtgacctaaactctacggtaaccgttaccgtttagtaccgtttaggtttttaactttccgtcggttacctaacggtaccgtagttacgttacgaaacggttaccggtcgggttaccgttccgttaacgtttcccggggacgggtaacgggaaccgttaacggggtaccggtaaccctaacgtaaaacccgtaacggttacggttaccgggtacgttccggtacccaaccggttcgttaacccgttcgttttaccgttacccgttaacgtttccccccgtttaccgggaccccttagtttaacccggg

SEQ ID NO: 5653 - DNA, 592 bp, Homo sapiens
  misc_feature: GYAE6OF02GYQEJ.8.28.C06.1.454.CMB.1.raw
  modified_base (208)..(208): a, c, t, g, unknown or other
  misc_feature (208)..(208): n is a, c, g, or t
  modified_base (297)..(297): a, c, t, g, unknown or other
  misc_feature (297)..(297): n is a, c, g, or t
tcagctcgcgtgtccacgaccggtgctcgatttagagctcacgtattgggtttggggaggaactgctcagttaggacccagacggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttggcgccttcgtaagctggtaccaacacaaacctggccaggcctcccaggccccctnactctatggtgcatccaacgacgggccacgtggcactcccagccaggttcagtggcagtgggtatgggacagacttcactctcaccatcatcacgtcctggacgcctagaagtatgttgctagtttacttacgtgtactaactagttcgtaccgtagttcggcccggtcccgggggtacctaccgtttccggaccccgtcgggaacccgtaagggtcggacggtacgtaccgaaacggtaaccgttcggtacggtacgtcgacctaccgtacgttaccgttcgttaccttctacc

SEQ ID NO: 5654 - DNA, 570 bp, Homo sapiens
  misc_feature: GYAE6OF02G566L.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggccgtcctttaacgagggccagtggaatcccagccaggttcagcggcagtgggtctgggacttcgttcactctcaccatcaataacctgacaatctagacgtactttgctagtttatttctgtcagtcagtctagaagtactcggtccgtttcacgtttcggcggtacgggaccgtaaggtcggtacctacgaaacgtacgtgtggtcgtcggcctaaccgtacttccgttagttcctttacgtacttcccgtttcccggacctattaccgg

SEQ ID NO: 5655 - DNA, 599 bp, Homo sapiens
  misc_feature: GYAE6OF02HT01J.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagcccaccctctcctgtgcggccagtcagagcgttaggacgaacttagcctggtatcagcagaggcctggccaggcctcccagacctcctcattctttggcgtcctttaacgacggggccaggtcggaactccccgaagcccgtaaggttcaggccggcaggtggggtctggggtactttcgttcactctcacctatcaaactaacctgactaatctgacgtactttgcttagtttattctgtcagtctagttcgtagaagtacgtcggtccgtttctacgttttccgggacgggtacgggaccgtaagggtcggtaaccgtacgaaacgtacgtggtacggtcgtcggaccaccgtatccgtgttccttacacgttcccttacccgcctactccg

SEQ ID NO: 5656 - DNA, 585 bp, Homo sapiens
  misc_feature: GYAE6OF02H8JU7.8.28.C06.1.454.CMB.1.raw
  modified_base (196)..(196): a, c, t, g, unknown or other
  misc_feature (196)..(196): n is a, c, g, or t
  modified_base (261)..(261): a, c, t, g, unknown or other
  misc_feature (261)..(261): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
tcagctcgcgtgtccacgaccggtgctcgatttagagctcacgtattggggtttggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagacgccaccctctcctgtgcggccagtcagagcgttaggaccgaacttagcctggtancagcagaggcctggccaggctcccagacctcctcatctttcggcgtcctttaacgagggcctagtacgggaactccccgagccgaggttcagcggcaggtggggtctgggtacttcgtcactctcactatcaaactaacctgcaatctcgacgtactttcgcttagtttactttntcgtntagctagtctagaacgtcgtcggtccgttcgtacgttcggcgggtacgggacgaacggtcggacctaacgaacgtacgtggtacgcgtggaccaccgtagtaccgtgttccttactaccgttcccgttcccgtacctataccgg

SEQ ID NO: 5657 - DNA, 619 bp, Homo sapiens
  misc_feature: GYAE6OF02I28ZQ.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagactcctcatcgtttggcgtccgtttaacgaggggccaggtcggaactccccgagcccgagggttcacggtcggcgaggtcggggtcgtcggggtacctttcggttcacgttcctccgaccataccaaatacctgactaactctacgaacgttactttcgtcttagttttactttcgtagtctacgtctagttcgtagaaacgtcgttccgggtaccgtttccgtaccgtttccgggacgggtaacggaccggtaaggtcggaaccttacgaaacgtactggtcgtacgcgaccactaacttcgtacgttctcctacttccctcccgtctctccg

SEQ ID NO: 5658 - DNA, 581 bp, Homo sapiens
  misc_feature: GYAE6OF02IBXQK.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcattctttggcgcctttaacgaggccagtcggaatcccagccaggttcagcgcagtgggtctgggacttcgtcactctcaccatcaatactgacaatctgacgtattgcttagtttattctgtcagtctagttctagtaagacgtcggtccgttcctacgtttccgggacgggtacgggaaccgtaagggtccggtaacctacgtaaaacgacgttggtacggcgtcggaccaccgtacttacgttcgttaccttccgtaacttcccgtttccccgtaccctatttaccgg

SEQ ID NO: 5659 - DNA, 654 bp, Homo sapiens
  misc_feature: GYAE6OF02HOPFU.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcggttaggacgaacttagcctggtatcagcagaggcctggccaggcctcccagactcctcattcttggcgtcctttaacgagggccagtggaactcccagccaggtcagcggcaggtgggtctgggacttcgtcactctcaccatcaataacctgacaatctagacgtactttgctagttttactttctgttacagtcctaagtccttaggaacgtacgttcggtcccgtttcgtaccggttttcggggaccgggtaacggggtaacccgtaaaggggttcgggtaaacccttaacggaaaaccggtaacgttacgggtacgggtaccgttacgggaaccctaaccgtaacgtttaccgttccggtttaccgtttacctaaccgtttcccctttcccccgggtacccttaacgttacccgg

SEQ ID NO: 5660 - DNA, 615 bp, Homo sapiens
  misc_feature: GYAE6OF02J2Y5L.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaacgtgctcagttaggacccagacggaaccatggaagccccagcgcagcttctcttcctcctgctactctggctcccagagatcattggagaagtggtgatgacacagtctccggtcaccctgtctgttttccnggggangagccaccctctcctgtgcggccagtcagagcgttaggacgaacttagcctggtatcgagcagaggcctggccaggctcccagtctccgtcatccttaggcctcctttaacgagggtccaggttggaactcccagccctaaggttccaggtcggctacggtgggtctgggtacctttcggtcacgtctcgaccatcctaataaccgtgactaatctagaccgtatttgacttagtttactttctagtcagtcacgttcgtagaacgtacctcggtacgttccgtacgtttcgggtacggtacggtaccgtaagggtcgtaccgtacgtaaaccggaacttcgggtgtacgtacggacctacaaccgtttcgagtttccttacgtacgtttccctttaccggtacctagttaccg

SEQ ID NO: 5661 - DNA, 532 bp, Homo sapiens
  misc_feature: GYAE6OF02FSDTR.8.28.C06.1.454.CMB.1.raw
  modified_base (418)..(418): a, c, t, g, unknown or other
  misc_feature (418)..(418): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacgagggccagtggaatcccagccaggttcagcggcagtgggtctgggacttcgttcactctcaccatcaataacctgcaatctgacgtactttgctagtttattctgtcngctagtctgaagtctcggtccgttcacgtttcgggcggtacgggacctaagggtcgactaccgaacgactggtggcgtcgacaccatctgtcttctacttcctcccgctatccg

SEQ ID NO: 5662 - DNA, 581 bp, Homo sapiens
  misc_feature: GYAE6OF02IHZJY.8.28.C06.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (260)..(260): a, c, t, g, unknown or other
  misc_feature (260)..(260): n is a, c, g, or t
  modified_base (311)..(311): a, c, t, g, unknown or other
  misc_feature (311)..(311): n is a, c, g, or t
  modified_base (391)..(391): a, c, t, g, unknown or other
  misc_feature (391)..(391): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagataccaccggagaaatttgtgttgacacagtctccagccaccctgtctttgcctccaggggaaanagccaccctntcctgcagggccagtcttagtgttagcaacttagcctggtacccaanagaaacctggccaggctcccaggcctcctcatctctgatacatcccaaacncggggcccacgtggaccatccccaagcccgtagggttcaggtggcagggttggggtctggggacacggtacttcacttcncaccatcagcagcctagagcctagtaagtattttcgacttactttaattacttgtcagtcagacgttagtactggcctttacgtcgtttccggcccgtacgggaacctaaggttgaacgttactaacgaaacgtacgtggtacggctcgaccactagttctgttcttccgacttcccgtcccgctatccg

SEQ ID NO: 5663 - DNA, 591 bp, Homo sapiens
  misc_feature: GYAE6OF02G20ZN.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgcctttaacngggccagtggaatcccagccaggttcagcggcagtgggtctgggacttcgttcactctcaccatcaataacctgcaatctgacactttgctagtttatttctgtcagtcagttctgaagtactggtcccgttcgtaccgttttccgggacgggtaacggggaccgtaagggtcggaccctaacgaaaccgtaaccgttggtacggaccgttcggacctaacccgtacgttccttggttacctttccgtaacttccccgtttcccggtaccctagttacccg

SEQ ID NO: 5664 - DNA, 673 bp, Homo sapiens
  misc_feature: GYAE6OF02I0968.8.28.C06.1.454.CMB.1.raw
  modified_base (166)..(166): a, c, t, g, unknown or other
  misc_feature (166)..(166): n is a, c, g, or t
  modified_base (195)..(195): a, c, t, g, unknown or other
  misc_feature (195)..(195): n is a, c, g, or t
  modified_base (445)..(445): a, c, t, g, unknown or other
  misc_feature (445)..(445): n is a, c, g, or t
  modified_base (622)..(622): a, c, t, g, unknown or other
  misc_feature (622)..(622): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacngtctccggtcaccctgtcttgttttccgnggggagagacgccaccctctcctgtcgcggcagtcagagcgttaggacgtaacttacgcctaggtactcaagcgagacggcctggccgaggtcctcccgagacctcctctactcgttcgggcctaccgtttaacacgggtccaggtacggaactcccaaggcccgtaaggttcgaggcggtcgtacggtcggggtcgtagggtacttcggttcaaccgtccgtacctacctactacctaaacgtaacccngtactaactcgttacgaaccgttaactttcgtacgtttaattttctttacgtacgtactaggtctacgttacgtagaagtacggtcggtaccgttcgttaaccggttcgggacgggacggtaaccgtacgtcgtaaccgtaccgaaagtaccgtggtacgtcgtcggacctaccctnttaccgttcgttaccgttacctacgttccccgtaaccgtccgtattcccgg

SEQ ID NO: 5665 - DNA, 610 bp, Homo sapiens
  misc_feature: GYAE6OF02HR2Y4.8.28.C06.1.454.CMB.1.raw
  modified_base (193)..(193): a, c, t, g, unknown or other
  misc_feature (193)..(193): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgttttccnggggagagagccaccctctcctgtgcggccagtcagagcgttaggacgaacttagcctggtatcagcagaggcctggccaggctcccagacctcctcattcgtttggccgtacctttaacgacgggtccaggttcggaaactccccgaagcccgtaggttcaggccggcaggtcggggtctgggacttcggtcactctcaccatacaactacctgacaatctagacgtactttgctagtttacttctgtcagtctagttctagtaagtcgtcggtccgttctacgtttccgggacgggtacgggtaaccgtagggtccggtaacccgtacgtaaacgtaccgtggtacggtcgtcgacctaccgtacgttccgttcggttcctttcgaaccgttcccttcccggtacctacgttccg

SEQ ID NO: 5666 - DNA, 562 bp, Homo sapiens
  misc_feature: GYAE6OF02HHLO8.8.28.C06.1.454.CMB.1.raw
  modified_base (424)..(424): a, c, t, g, unknown or other
  misc_feature (424)..(424): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcctcctttaacagggccaggtggaactcccagccaggttcagcggcaggtgggtctgggacttcgtcactctcaccatacaataacctgactaatctgacgtactttgctagtttacttctgtcngcagtctagagactggtccgttctacgtttcgggacgggtacgggaccaagggttcggaacctacgaaacgtactggtacggctggacctaccagttccgttgttccttacctattcccgttacccgtacctagtccg

SEQ ID NO: 5667 - DNA, 523 bp, Homo sapiens
  misc_feature: GYAE6OF02GU77U.8.28.C06.1.454.CMB.1.raw
  modified_base (383)..(383): a, c, t, g, unknown or other
  misc_feature (383)..(383): n is a, c, g, or t
  modified_base (492)..(492): a, c, t, g, unknown or other
  misc_feature (492)..(492): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaactcccagccaggttcagcggcagtgggtctgggacttcgtcactctcacatcaataaccngcaatctgacgtactttgctagttttattctgtcagtcagtctagaagtctcggtccgttctacgtttcgggcggagggaccgtaagggtcggacctacgaacgactgnggctgcacatctgtcttcactcctccgcatc

SEQ ID NO: 5668 - DNA, 777 bp, Homo sapiens
  misc_feature: GYAE6OF02JNP72.8.28.C06.1.454.CMB.1.raw
  modified_base (140)..(140): a, c, t, g, unknown or other
  misc_feature (140)..(140): n is a, c, g, or t
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
tcagctcgcgtgtccacgaccggtgctcgatttagagctcacgtattgggtttgggggtagggaacgtgctcagttaggacccagacggaaccatggaagcccagcgcagctctcttcctctgctactctggctcccagngatcattggagaagtggtgatgacacagtctccggtnaccctgtctgtttttccngggganagagccacctcncctgtncggccagtcagngcgttaggacgacttagacctggtatcagcagagcctggccaggcctcccgagacctcctccgtaatctttacgggccgtccgttttaaacacggggtcctacggtcgggtaaactccccgtagaccctacggggtttacgacggtacgggccgtaaggttcgggggtaccgtttagggggaacctttttacccgggtttcaacccggtttcgttaccgaacccccgtaattaccccgaaaacgtttaaacccgttaggaccctaaacgttaccgttaccggtaaccggttaacccgttttacggtaccgtttaacgttttaacgtttacgtttaccgtttccgttaacggtaccgttacggttacccgttagggtaaacgtaccgttaccgggttacccgttacgtttacccgtttacgggtaccggggtaacgggtaccggtaacgggttacggtaccgttaccgaaaccgtaacgtagtacggctacggacctacgacttacgtcgttaccttcgtacgttaccgtaccccgtcgtaacctcg

SEQ ID NO: 5669 - DNA, 776 bp, Homo sapiens
  misc_feature: GYAE6OF02IQNXU.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctcncctgtgcggccagtcagngcgttagacgaacttagctggtatcagcagaggcctggccaggcctaccagacctcctctatcgtttggccgtacccttttaacgacgggcctacggtacggaaacttccccgaacgcccgtaagggtttccaacggccgggtacgaacggttcggggttcccgttaggggtaccgtttacccgggttttcaacccgtttcgtacccgtaaacctacgtttaccaaaacttaaacccgttggaacctaaatccgttacggaaccgttaacgtttcggacgttaaacgttttcgtttacgtcgttacctaaggaccttaggttaccttaggaaacgtccggttacggtcccggtttacgttaacccggtttcggggtaaccggggtaacggggtacccgtaaacggggtcggttaaacccgtaacgtaaaaccgggttactacggggttacgaccggttacggaaccctaacccggttacgttacccgttaggtttacccctttacggttaaccgttccccgtttcccgtacccgttaagttcccgg

SEQ ID NO: 5670 - DNA, 610 bp, Homo sapiens
  misc_feature: GYAE6OF02GG3YX.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgttttccgtggggagagagccaccctctcctgtcgcggccagtcagagcgttaggacaacttagcctaggtatcagcagaggcctggccaggctcccagacctcctcatcgttggcgtcctttaacgaggccagtggaactccagccaggttcagcggcaggtggtcgtgggtacttcgttcacttctaccaccgattacaaacttaacctagtacaacttctacgaacgttacttttgacttaagttttactttcttcgtactaggtctaggttctaggtaacgcgtttacgggaccctttgtaccgtttcgggacggtacgggacgtaagggtcgaacgtaccgaagacgttgtacggtcgtagaccaccgtattccgttacgttccttacgtccgttaccttccccgtacgtacttaccgg

SEQ ID NO: 5671 - DNA, 562 bp, Homo sapiens
  misc_feature: GYAE6OF02JAJQG.8.28.C06.1.454.CMB.1.raw
  modified_base (195)..(195): a, c, t, g, unknown or other
  misc_feature (195)..(195): n is a, c, g, or t
  modified_base (310)..(310): a, c, t, g, unknown or other
  misc_feature (310)..(310): n is a, c, g, or t
  modified_base (341)..(341): a, c, t, g, unknown or other
  misc_feature (341)..(341): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggctcctttaacngggccagtggaatcccagccaggtcagcggnaggtggtctggacttcgtcactctcaccatcaatacctgacatctgactattgactagtttacttctgtcagtctagtctagaagtctcgggtccgttctacgtttccgggacggtacgggtaccgtaagggtcggaccctacgaaacgtacgtggtacggcgtcgacctacctagttccgttggttaccttcgtacttcccgttccccgacctactccgg

SEQ ID NO: 5672 - DNA, 554 bp, Homo sapiens
  misc_feature: GYAE6OF02IAV03.8.28.C06.1.454.CMB.1.raw
  modified_base (194)..(194): a, c, t, g, unknown or other
  misc_feature (194)..(194): n is a, c, g, or t
  modified_base (301)..(301): a, c, t, g, unknown or other
  misc_feature (301)..(301): n is a, c, g, or t
tcagctcgcgtgtccacgaccggtgctcgatttagagctcacgtattgggtttgggggagaactgctcagttaggacccagacggaaccatggaagccccagcgcagcttctcttcctcctgctactctggctcccagagatcattggagaagtggtgatgacacagtctccggtcaccctgtctgtttttccnggggagagagccacctctcctgtgcggccagtcagagcgttaggacgaattagcctggtatcagcagaggctggcaggctccagactctcatctttggctcttaacnggccagtggaactcccagccaggttcagcggcaggtgggtctgggacttcgtcactctcacatcaataacctgacatctgactacttcgctagtttattctgtcagtctagttctagaacgtactcggtccgtttctacgttttcggacgggtaacgggtaccgtaacgggtcggaacctacgaaacgaactaggtacggtcgtcgaccacacgttctcgttacttctacttccgtacccgtacctattaccg

SEQ ID NO: 5673 - DNA, 595 bp, Homo sapiens
  misc_feature: GYAE6OF02IX9ZK.8.28.C06.1.454.CMB.1.raw
  modified_base (195)..(195): a, c, t, g, unknown or other
  misc_feature (195)..(195): n is a, c, g, or t
  modified_base (312)..(312): a, c, t, g, unknown or other
  misc_feature (312)..(312): n is a, c, g, or t
  modified_base (368)..(368): a, c, t, g, unknown or other
  misc_feature (368)..(368): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggcctcccagacctcctcatcttggcgtcctttaacngggccaggtggaactccagccaggtcagcggcagtgggtctgggcttcgtcactcncacatacaatacctgcaatctgacgtactttgactagtttatttctcgtcagctagttctaggaagtcgttcgggccgtttactaccgttttcgggacgggtacgggtaccgtaagggttacggaacccttaacgaaacgtaacgttcggtacggtaccgtggaccctaaccgtaactccgttacgttacctttcgaccttccccgttcccggtaccctattaccgg

SEQ ID NO: 5674 - DNA, 590 bp, Homo sapiens
  misc_feature: GYAE6OF02F32AZ.8.28.C06.1.454.CMB.1.raw
  modified_base (345)..(345): a, c, t, g, unknown or other
  misc_feature (345)..(345): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagactcctcatctttggctcctttaacgagggccaggtgaactcccagcctaggtcagcggnagtgggtctgggtacttcgtcactctcacataccaatacctgactaatctagtacgtactttgctagtttattctgtctagtctagtctgaagtcgtggtcccgttacgtaccgtttcgggacgggaacggggtaccgtaagggtacggtaaccctacgaaaccgtaacgttgtacgggtcgtacggccgtaaccgtacgttccgttagtcctttcctaccttcccgttccctaccgtactccgg

SEQ ID NO: 5675 - DNA, 595 bp, Homo sapiens
  misc_feature: GYAE6OF02IYD7Z.8.28.C06.1.454.CMB.1.raw
  modified_base (198)..(198): a, c, t, g, unknown or other
  misc_feature (198)..(198): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (589)..(589): a, c, t, g, unknown or other
  misc_feature (589)..(589): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaaggtggtgatgacacagtctccggtcaccctgtcttgtttttccgnggggagagacgccaccctctcctgtgcggccagtcagagtcgttaggacgtaacttagccttggtactcagcagaggcctggccaggcctcccagacctcctcacttctttgggccgtacctttaacgagggccagtggaactcccagtacctaggttccgagcggcaggtcgggtctgggtaccttcggtacacttcgtactaccacttcaaacttaaccgtgaccaatctacgaccgttactttgcttagtttactttctcgtanagtntagttcgagagtctaggtccttacgtacgttggccgggaaggtaccgaggtccgactaaccgaagtacttggcgtacgtcgacactatccttacgttctactaccttccgtaccctactnttaccg

SEQ ID NO: 5676 - DNA, 625 bp, Homo sapiens
  misc_feature: GYAE6OF02H5RAV.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcattccgtttggccgtaccttttaaccgaggggtccaaggtggaactcccgagccgaggttcaggcggcaggttcgggtctggggacctttcgttcacgtctcacctatacaaactaacctgactaacttctacgacgtactttgacttagttttacttcttgtcagtctagttctagtaacgtacgtcgggtccgttcgtacgtttcgggacgggtaacgggtaccgtaaggggtcggacccgtaacgaaccgtaacgttggtcggtacgtcgtaccgaacctattccgttcgttcctttacacctttcccgttccccgtacctattaccgg

SEQ ID NO: 5677 - DNA, 634 bp, Homo sapiens
  misc_feature: GYAE6OF02INBT9.8.28.C06.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgttttccngggganagagccacctctcctgtgcggcagtcagagcgttaggacgaacttagcctggtatcgagcagaggcctggccaggcctcccgagacctcctctattcctttggccgtacctttaacgagggcctaggtggaactccccgaagccctaggttcaggcggctaggtgggtctggggtacttcggttcactctcaacctatacgaaataacctgacaatctacgacgtactttgcttaagtttatttctgtcaaggtctagttctaggaacgtctcggtccgttacttacgtttccggggacggtaacgggaacccgtaagggtaccggtaccgtaccgtaaacgtaaccgttggtacggtccgtcggaccgtaacctacgttaccgttacggttccctttacgtaccgtttccctttaccccggtacctagttcccg

SEQ ID NO: 5678 - DNA, 520 bp, Homo sapiens
  misc_feature: GYAE6OF02GCPAV.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgcctttaacgagggccaggtggatcccagccaggttcagcggcaggtgggtctgggacttcgtcactctcaccatcaaataacctgacaatctgacgactttgctagtttattctgtcagcagtctgaagtactggccgttcacgtttcggcggagggaccaagggtggacctacgaaacgactgtggctgccacatctgtcttcactcctcccgcatcg

SEQ ID NO: 5679 - DNA, 552 bp, Homo sapiens
  misc_feature: GYAE6OF02HKP14.8.28.C06.1.454.CMB.1.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
  modified_base (311)..(311): a, c, t, g, unknown or other
  misc_feature (311)..(311): n is a, c, g, or t
  modified_base (397)..(397): a, c, t, g, unknown or other
  misc_feature (397)..(397): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagtttcagataccaccggagagattgtgttgacacagtctccagccaccctgtctttgtctccaggggaaagngccaccctctcctgcagggccagtcagaatgttgcncttgtaagctgtaccaacacaaactggccaggctcccaggcccctcatctatggtgcatccaacnggccactggcatcccagccaggttcagtgcagtggtatgggacagacttcactctcacatcatcacgcctggacgtcctagaagtntgttgctaagtttattactgtcaactatacgtacgagtcggccgtccggggcctacgtttccggccgtacgggaccaagggttcggagtacgtaccgaaacggaccttaggtcggtacgtgaccgacctacgttcgttacgttccgttactaccg

SEQ ID NO: 5680 - DNA, 520 bp, Homo sapiens
  misc_feature: GYAE6OF02FIJR2.8.28.C06.1.454.CMB.1.raw
  modified_base (341)..(341): a, c, t, g, unknown or other
  misc_feature (341)..(341): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacaggccagtggaatcccagccaggttcagcggnagtgggtctgggacttcgtcactctcaccatcaataacctgacaatctgacgactttgctagtttatttctgtcagcagtctgaagactggtccgttcacgttttcgggcggtagggaccgaagggtcggaccgtcaaacgacgtgtggctgcaccatctgtcttcattctcccgcatc

SEQ ID NO: 5681 - DNA, 534 bp, Homo sapiens
  misc_feature: GYAE6OF02FTK4Z.8.28.C06.1.454.CMB.1.raw
  modified_base (302)..(302): a, c, t, g, unknown or other
  misc_feature (302)..(302): n is a, c, g, or t
  modified_base (530)..(530): a, c, t, g, unknown or other
  misc_feature (530)..(530): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttttcctggggagagagccaccctctcctgtgcggccagtcagagcgttaggacgaacttagcctggtatcagcagaggcctggccaggctcccagactcctcatctttggcncctttaacagggccagtggaactccagccaggttcagcggcaggtggtctgggacttcgttcactctcaccatcagcagcctagacgcctagaagtatttgctagtttattactgtcaacatcgtacgagtcggccgtccggggcctacgtttccggcccgtcgggaacctaaacgttgacgacgtacaaacgactgtggctgcaccatctcgtcttctatccttccnctac

SEQ ID NO: 5682 - DNA, 561 bp, Homo sapiens
  misc_feature: GYAE6OF02FOXUQ.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgtcttgtttttccgnggggagagagccaccctctcctgtcgccggccagtcagagcgttaggacgaacttagcctggtatcagcagaggcctggccaggctcccagactcctcattctttggcgcctttaacgcgggccaggtaggaactcccagccaggttcacggcggcaggtgggtcgtggggactttcgtcactctcaccatcaaactaacctgacaatctcgacgtactttgctagttttattctgtcagtcagttactagaagacttcggtccttcgtacgtttcgggcgggtaacgggaccgaagggtcggacctacgaaacgtacgtgtgcgtgaccactatctgtcttcacgttcctcccgactgtccg

SEQ ID NO: 5683 - DNA, 535 bp, Homo sapiens
  misc_feature: GYAE6OF02G01H5.8.28.C06.1.454.CMB.1.raw
  modified_base (310)..(310): a, c, t, g, unknown or other
  misc_feature (310)..(310): n is a, c, g, or t
  modified_base (361)..(361): a, c, t, g, unknown or other
  misc_feature (361)..(361): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacngggccagtggaatcccagccaggttcagcgcagtgggtctgggacttcgtnactctcaccatcaataacctgcaatctgacgtactttgactagttttattctgtcagtctagttctagaagtactggtcccgttctacgtttcgggcggaagggaccaagggtcgactacgaacgtactgtcggctggcctaccatcgtgtacttcacttcctcccgctatccg

SEQ ID NO: 5684 - DNA, 599 bp, Homo sapiens
  misc_feature: GYAE6OF02HKX9K.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcatctttggccgtcctttaacacgggccaggtcggaactcccagccaggttcagcgcagtgggtctgggtacttcggtcactctcaccatacaatacctgcaatctagacgtacttgctagtttattctgtcagtctagttctagaacgtactcgggtccgtttctaccgttttcgggacgggtaacgggaccgtaacgggtcggtaacccttacgaaacgtaacgtcggtacggtcctaggcctaaccgtaacgttccgttagttcctttccgtacgtttccccgtttcccggtaccctacttccg

SEQ ID NO: 5685 - DNA, 591 bp, Homo sapiens
  misc_feature: GYAE6OF02ID580.8.28.C06.1.454.CMB.1.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
  modified_base (354)..(354): a, c, t, g, unknown or other
  misc_feature (354)..(354): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtcgcggccagtcagagcgttaggacgaacttagcctggtatcagcagaggcctggccaggctcccagactcctcatctttggcgtcctttaacgngggccagtgactcccagccaggttcagcggcaggtgggtcngggtacttcgtcactctcacatcaactaactnacaatcngacgtcttgctagtttattctgtcagtctagtctagaacgtcgtcgggtccgttcgtaccgtttcggacgggaacggggtacctaaagggttcggacccgtaacgaaacgtacgtcggtacggacgtcggacccaacgtacgttccgttacggttcctttaccgttaccttcccggtttccccgtcctagttacccgg

SEQ ID NO: 5686 - DNA, 616 bp, Homo sapiens
  misc_feature: GYAE6OF02F6DO3.8.28.C06.1.454.CMB.1.raw
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggcccaggctccccagactcctcatctttggcgcctttaacngggccagtggaatcccagccaggttcagcggcaggtgggtctgggacttcggttcactctcaccatcaataacctgcaatctgaccatttgctagtttatttctgtcagctagttctagaacgacttgggccgtttcaccgttttcgggccgggaagggtacccgaaaggggttcggaacccgttacgaaaaccggtaacctgggtacggtccgttcggacctaaccctaacgttccgtttacgggttccctttaccgtaaccgtttccccgttttaccccccggaccgttaacctttacccgg

SEQ ID NO: 5687 - DNA, 838 bp, Homo sapiens
  misc_feature: GYAE6OF02GZDII.8.28.C06.1.454.CMB.1.raw
  modified_base (204)..(204): a, c, t, g, unknown or other
  misc_feature (204)..(204): n is a, c, g, or t
tcagctcgcgtgtccacgaccggtgctcgatttagagctcacgtattggggtttgggggaggaactgctcagttaggacccaggacggaaccatggaagccccagcgcgaggccttctcttcctcctgcctacgtctcggctcccagagatcacttggagaagtggtgatgacacagtctcggtcaccctgtcttcgttttccnggggatagacgccacctctcctgtgcggccagtcagacgcgttacggacgtaacgttacggcctagggtactacgagtacaaggaacggcctaggaccgtacgggtcccttacccaaggtaaccttccctaacgtaaaccgttccggtttacgggaccccgttaaccgttttaaaaccggacggggtaccctaaggtacgggtaaacctccccgaaggtacccgtaacgggtttccgaacgggtccgggactacggggttcggggtccggttacgggtacttttccgggttactaccgtccggtaccaccgtaacgttacaaaacgttaccgtcggaactaacttacgttaacgacgttaacttttcgacccgttaagttttacgttcgtacgtaccgtagtaccgtagttacgttaaggaacggtacgttcgggttacccgtttacgtaaccggttttccggggaacgggtaaaccgggtaaccgttaacggggttacgtaacccggtaaacgtaaaaccgttaccgggtcggttaacgaccggttccggaacccgtacggttacgttaaccggttagttaccccgtttacggtaacccgttaccccgttacccggtccttaaggttacccgg

SEQ ID NO: 5688 - DNA, 700 bp, Homo sapiens
  misc_feature: GYAE6OF02JRMVI.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggcagtcagagcgttaggacgacttagcctggtatcagcagagcctggccaggctccagactcctcatcttggctcctttaacaggtccagtcggaactcccagccagttcagcgcagtggtctgggaccttcgttcacgtcctacgacctagtcaaacttacccgtagaccaacttcgtagaccgtaactttcgacgttagtttttaacttcgttacgtacgtagtccgttaagttcctaggtaaacgtacgttccggggtaccctttaccggtaccttttacccggggggaccgggtaaacgggggtaacccgtaaacgggggttccggtaaaccccgttaacggtaaaacccggtaacggttcgggtacggttacccgtaacggtaccctaaccgtaaccgtttaccggttaccgttttaccgtttacccgtacggttttacccccctttacccgggtcccctaagtttaccccgg

SEQ ID NO: 5689 - DNA, 571 bp, Homo sapiens
  misc_feature: GYAE6OF02G5ZR8.8.28.C06.1.454.CMB.1.raw
  modified_base (195)..(195): a, c, t, g, unknown or other
  misc_feature (195)..(195): n is a, c, g, or t
  modified_base (410)..(410): a, c, t, g, unknown or other
  misc_feature (410)..(410): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagcccaccctctcctgtgcggccagtcagagcgttaggacgaacttagcctggtatcagcagaggcctggccaggctcccagactcctcatctttggcgtcctttaacgagggccaggtggaactccagccaggtcagcgcaggtgggtctgggacttcgtcactctcacatcaaatacctgacatctgacgtactttgctagtttnttcgtcgtcagtctacgtctagaacgtacgttcggtccgttctacgtttcgggcgggtacggaccgtaagggtcggaaccgtacaacggtactggtacgtcgtcgcctacgtactccgttcgttaccttacgtaccttccgttaccccgtactacttaccg

SEQ ID NO: 5690 - DNA, 556 bp, Homo sapiens
  misc_feature: GYAE6OF02FZJZX.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcattctttggcgtcctttaacgagggccaggtggaactcccagccaggttcagcggcaggtgggtctgggacttcgtcactctcacatcaatacctgacatctgactatttgctagtttattctgtcagtctagtctagaacgtctcggtccgttcgacgtttcgggacgggtacgggacctaagggtcggaccctacgaaacgtacttggtacggacgtggaccacctagttcgtgtccttctacttcccgtacccgtctactcg

SEQ ID NO: 5691 - DNA, 614 bp, Homo sapiens
  misc_feature: GYAE6OF02F50RH.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagagcctggccaggctcccagactccncatctttggcncctttaacnggccagtggaatcccagccaggttcagcggcaggtgggtctgggacttcgttcactctcacatcaatacctgcatctgaccgtactttgcttagttttactttctcggtacagtactagttctaggaagtaccgttgggtacccgtttacgtaccggttttccgggaccgggtaacgggtacccgtaaagggtaccggtaacccgtacgtaaaaccgtaaccgttggtacggtacctggaccgtaaccctacgttccgtacgttccttacgtaaccgttcccggtttaccccgcgtaccttaccgg

SEQ ID NO: 5692 - DNA, 811 bp, Homo sapiens
  misc_feature: GYAE6OF02GDXX0.8.28.C06.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
tcagctcgcgtgtccacgaccggtgctcgatttagagctcacgtattgggtttgggggtagggaacgtgctcagttaggacccagacggaaccatggaagcccagcgcagctctcttcctcctgctactctggctccagagatcattggagaagtggtgatgacacagtctcggtcaccctgtctgttttccngggganagagccacctctcctgtgcggcagtcagagcgttaggacgtaacttaggcctaggtactcgtagcgaaggaggtcctggcctaggcctacccgacgtacctcccgtactacgttcgtttcgggccgtaccgttttaaacgacgggtacccgaaggtttacgggaaacccttccccgaacgggtacccgtaacggggttttacccaagggcccgggtaccgtaacggggttcggggttaccggtttaccgggggtactttcccggggtttaaccgtaccgttaccgtccgtaaacccgttaattaccccgtaaacgttaaacccgtggtaccctaacgttaccgtacgtaccggtacgtttacgacgttacgttttaacgtttacgtgttaccgtaacgctaaggttccttaggaaacgttccgtcgggttacccgtttcgtaaccggttttaccgggaccggggtaaccggggtaaccgtaacgggtacggttaaacccgtacgaaaaccggttcggttacggcggtaaccgttccgggaactaccctaagttcgttaccgttaccgttacgttaaccgttcccgtttaccccgtaccgttacgttacccgg

SEQ ID NO: 5693 - DNA, 576 bp, Homo sapiens
  misc_feature: GYAE6OF02H50QM.8.28.C06.1.454.CMB.1.raw
  modified_base (312)..(312): a, c, t, g, unknown or other
  misc_feature (312)..(312): n is a, c, g, or t
  modified_base (393)..(393): a, c, t, g, unknown or other
  misc_feature (393)..(393): n is a, c, g, or t
tcagctcgcgtgtccacgaccggtgctcgatttagagctcacgtattggggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcatctttggcgcctttaacngggtccagtcggaatcccagccaggttcagcggcagtcgggtctgggacttcgttcactctcacatcaatacctgacatcngacgactttgctagtttattctgttacagtcgtagtctagaacgtactcgggtaccgttcgtaccgttttcgggaccgggtaggtaccgtaacggtacggtaaccctacgtaaacgtaacgtaggttacggccgtgacctacgattacgtgttccttacgacttccttccccgactactaccg

SEQ ID NO: 5694 - DNA, 595 bp, Homo sapiens
  misc_feature: GYAE6OF02HF6FM.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggcctcccagactcctcatcgtttggccgtcctttaacgagggccaggtggaactcccagccaggttcaggcggcaggtgggtctgggtcttcgtcactctcaccatcaatacctgacaatctagacgtactttgactagttttattcgtgtcagtctacgttctaggaagtaccgtcggtccgtttcgtaccgtttcgggacgggtaacgggtaccgtaagggttcggaccgtaacgaaaccggtacgtgggtacggtacgtcggaccaacctagttaccgtgttccttctaccgtttccctaccccggtctacttccg

SEQ ID NO: 5695 - DNA, 537 bp, Homo sapiens
  misc_feature: GYAE6OF02GRC94.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagccaccctctcctgtgcggccagtcagagcgttaggacgaacttagcctggtatcagcagaggcctggccaggctcccagactcctcatctttggcgtcctttaacagggccagtggaactccagccaggttcagcggcagtgggtctgggacttcgtcactctcaccatcaataacctgcatctgacgtactttgctagtttatttctgtcagcagtctgaagactggtccgttcaccgtttcggcgggtagggaccgaagggtcgacctacgaaaccgactaggtggctgcctaccgattctgttcttcgtattccttccccgtccatcg

SEQ ID NO: 5696 - DNA, 634 bp, Homo sapiens
  misc_feature: GYAE6OF02HYK2Q.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagacgccaccctctcctgtcgcggccagtcagagcgttaggacgaacttagcctggtatcagcagaggcctggccaggcctcccagactcctcatctttggccgtcctttaagacgggccagtggaactcccagccaggtcagtgcagtggtctgggtacttcgtcactctcacatactaataacctagtaaactctagacgtactttgcttagttttactttctgtacagtctacggttctagaacgtacgtggtacccgtttacttaccggttttacgggccgggaaacggggtaccgaaacggggttcgtaacccgtaccgaaaacggtacgtcgggtacgggaccttacggaccctaaccgtattaccgttcggtttacccttaccgtaccgttacccgtttaccccggaccttacttcccgtaacggg

SEQ ID NO: 5697 - DNA, 615 bp, Homo sapiens
  misc_feature: GYAE6OF02JFTTH.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
  modified_base (421)..(421): a, c, t, g, unknown or other
  misc_feature (421)..(421): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcngggganagagccaccctctcctggtgcggccagtcagagcgttaggacgaacttagcctggtatcagcaggaggcctggccaggcctcccgagactcctnacgttcgtttggccgtacctttaacgcggggccaaggtacggaactcccgaacgccgtaaggttccaggccggactagggtcgggtcgtgggtactttcgtcacttctaccacatacaactaccgngacaatcgtgacgtactttgacttagtttacttctgtctagtcgtagtacgtagaacgtacgttcggtccgttcgttacgtttacgggacgggtaacgggtaaccgtaggtcggtaacctacgaaaccgtacgtggtcggacgtcgacctactacgtcgttgttacctactaccttcccgtacccactacgtcg

SEQ ID NO: 5698 - DNA, 807 bp, Homo sapiens
  misc_feature: GYAE6OF02I62SF.8.28.C06.1.454.CMB.1.raw
  modified_base (198)..(198): a, c, t, g, unknown or other
  misc_feature (198)..(198): n is a, c, g, or t
  modified_base (740)..(740): a, c, t, g, unknown or other
  misc_feature (740)..(740): n is a, c, g, or t
tcagctcgcgtgtccacgaccggtgctcgatttagagctcacgtattgggtttggggaggaactggctcagttaggacccagacggaaccatggaagccccagcgcagcttctcttctcctgctactctggctcccagtagactcattggagaagtggtagatgacacagtctccggtcaccctgtctgtttttccgnggggtagagacgccaacctctcctgtcgccggccagtcagacgcgttaaggacgtaacttagaccgtaggtatccaaggccgaaggacggaccgtacgggacctaacgggccttacccgaacggtaccttccgtactaactttccgttttcggaccggttaccgttttaaacgacggggttacccgaacggtacgggtaaaacctaccccgtaaggacccgtaacgggtttacgaacgggtaccggtacgaacgggttcggggtaccgttacggggtaccgtttaccggtttacgtaaccgtttcctaaccggaaaccgtacgttaacaaaaccgtttaacccgtagaacctaacgttacgtacggtaacgttacctttgaaccgttaagttttacttacgtcgttacgacggttacgtacgttaccgtaagtaacgtacggtacgtaccgttcgttaaccggtttccggaagggtaaccggtacgttaaaggggtcccgtaaacgttaaccgaaacgtacggttacgacggtaccgtaacnccggttaaccacgtttacgttacgttacgttaccgtacttacccgttccggtacccttagtaaccgg

SEQ ID NO: 5699 - DNA, 611 bp, Homo sapiens
  misc_feature: GYAE6OF02ISW8L.8.28.C06.1.454.CMB.1.raw
  modified_base (389)..(389): a, c, t, g, unknown or other
  misc_feature (389)..(389): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggcgtcctttaacgaggggccaggtggaactcccagccaggttcagcggcaggtgggtctgggacttcgttcactctcacatcaataaccngacaatctgacgtactttgctagtttattctgtcagtcagttctagaagtactcgggtccgttctacgtttcgggacgggtaacggggaaccgaacgggttcggaacccgttaacgaaaaccgtaacgttggtacgggccgtacggaccctaaccgacgttccgttacggtttccctttaccgtaacctttccccgtttacccccggtaccctaattcccgg

SEQ ID NO: 5700 - DNA, 529 bp, Homo sapiens
  misc_feature: GYAE6OF02HD8HO.8.28.C06.1.454.CMB.1.raw
  modified_base (512)..(512): a, c, t, g, unknown or other
  misc_feature (512)..(512): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtataagcagaggcctggccaggctcccagactcctcatctttggcgcctttaacagggccagtggaatcccagccaggttcagcggcagtgggtctgggacttcgttcacgtctcaccatcaataacctgctaatctgacgtactttgctagtttatttctgtcagctagtctgaagtactggccttcacgtttcgggcggtacgggaccgaagggtgaccgtacgaaacgtactgtggctggcaccatctgtctcnctctccgctactctacg

SEQ ID NO: 5701 - DNA, 551 bp, Homo sapiens
  misc_feature: GYAE6OF02ISKCB.8.28.C06.1.454.CMB.1.raw
  modified_base (195)..(195): a, c, t, g, unknown or other
  misc_feature (195)..(195): n is a, c, g, or t
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
  modified_base (513)..(513): a, c, t, g, unknown or other
  misc_feature (513)..(513): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgtcctttaacagggccagtggatccagccaggttcagcgnagtgggtctgggacttcgtcactctcacatcaataccngcatctagacgtctttgacttagtttattctgtcagtctagttctagacgtactggtccgttcgtacgtttcgggcggtaacgggtaccgtaagggtcggaacccgtacgaaacgtacgtggtcggacgtgaccnctaactctcgttcttctacttccctcccgcctattccg

SEQ ID NO: 5702 - DNA, 722 bp, Homo sapiens
  misc_feature: GYAE6OF02GNR5M.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgtggggagagacgccaccctctcctgtgcggccagtcagagcgttaggacgaacttagcctggtatcagcagaggcctggccaggcctcccgagacctcctcattccgtttcggcgtacctttaacgacgggccctaaggttcggaactccccaagtcccgtaaggttccaggccggctaggtcgggtcgtcgggtacttccggttcacttcgtaccacctataacctaaactaaccgtgactaagtctagaccgtactttcgaccttaagttttactttcgtacgtcgtacgtacgtacgttacgtacgtaacggtaccgtcgggttacccgtttaccgtaccggttttccggggtaacggggtaccgggtaaccggtaaacgggtacggaacccgttaaccgtaaaaccgtacggttacgggttacgggtaccttccgggaccttaaacccgtacgtttaccgtttccggttaccttttccgttaaccgtttccccggttaccccgtacccgttaaccgttcccgg

SEQ ID NO: 5703 - DNA, 585 bp, Homo sapiens
  misc_feature: GYAE6OF02I8P35.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagactcctcattcttggcgtcctttaacgaggggccagtggaactccagccaggttcaggcggcaggtgggtctgggacttcgttcactctcacatcaatacctgcaatctgacgtactttgtctagttttactttctgtcagctagttctaggtaacgtcgttacgggtccgtttacctacggtttccgggacggggtaacgggaaccgaagggttcggaaccctacgaaaccgtacgttgtcggccgtcggacctaccgattccgttagttcctttcaccttcccgttccccgactactcg

SEQ ID NO: 5704 - DNA, 651 bp, Homo sapiens
  misc_feature: GYAE6OF02JDHRO.8.28.C06.1.454.CMB.1.raw
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (391)..(391): a, c, t, g, unknown or other
  misc_feature (391)..(391): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagcccaccctctcctgtgcggccagtcagagcgttaggacgaacttagcctggtatcagcagaggcctggccaggcctccagactcncatcttggctccttaacnggccagtggaatcccagccaggttcagcgcaggtgggtctgggaccttcgtcacgtctcaaccagtcaaatacctgacaatcncgtaacgtactttggacttagtttatttacgtgtaccgagtctaacgttcttaggaaacgtaccgtcggtcccgttacgttaaccgtttccggggacgggtaaccgggaccgttaaacggggttcggaacccgtaacgtaaacccgggtaacgttcgggttaaccggcgttaccgggacctaaccggtaacttaccccggttagtttacccgtttaccgtacgttaccccggttttacccccggacccttaagttcccgg

SEQ ID NO: 5705 - DNA, 611 bp, Homo sapiens
  misc_feature: GYAE6OF02GR88B.8.28.C06.1.454.CMB.1.raw
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
  modified_base (386)..(386): a, c, t, g, unknown or other
  misc_feature (386)..(386): n is a, c, g, or t
tcagctcgcgtgtccacgaccggtgctcgatttagagctcacgtattgggtttgggggagggaacgtgctcagttaggacccagacggaaccatggaagcccagcgcagcttctcttcctcctgctactctggctcccagagatcattggagaagtggtgatgacacagtctccggtcaccctgtctgtttttccgtggggagagagccaccctctcctgtgcggccagtcagagcgttaggacgaacttagcctggtatcagcagaggcctggccaggcctcccagactcctnacttcttggctctttaacgaggccagtgaactccagccagtcagcggnaggtggtctgggacttcgttcactcgtcactatacaattaaccngactaatctacgacgtactttgaccttagtttactttcgtagtctagtactagttctagaaagtaccgtcggtaccgtttcgtaaccgtttccgggacgggaacgggtaacccgtaagggttaccgaacccttaaccgaaaacgtaaccgttggtacggtccttacggaccgtaacctacgttacgttccgttcttacctactcccgtttcccgactacttaccg

SEQ ID NO: 5706 - DNA, 743 bp, Homo sapiens
  misc_feature: GYAE6OF02HUU02.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagcccaccctctcctgtgcggcagtcagagcgtagacgaacttagctggtatcagcaggagcctggccacggcctcccagacctcctcacttcgtttcggccgttacctttaacgacgggtccaggtacggaacctcccgagccgtaggttccacggcggacgtagggttcgggtcgttcggggtacctttccggttaccacttccgacctaacctactaaccgtaaacttaacccgtgacctaagttcgtaacggtaaccgtttactttacggtaccttaaagttttttactttccgtaggttaccaggtaccgttaaggttccgtaaggaaacggttaccgtcccggggttacccgtttttaaccggtacccgggtttcgggggaaccggggtaacgggtaacccggtaacggggttaccggaaacccttaaccggaaaaccgttacgtcgggtaccggtccgtcgaacccgtacctaccgttcgttcgttaccttaccctaccgttccccgttaccccggtactaccgttaccgg

SEQ ID NO: 5707 - DNA, 619 bp, Homo sapiens
  misc_feature: GYAE6OF02IASYJ.8.28.C06.1.454.CMB.1.raw
  modified_base (193)..(193): a, c, t, g, unknown or other
  misc_feature (193)..(193): n is a, c, g, or t
  modified_base (312)..(312): a, c, t, g, unknown or other
  misc_feature (312)..(312): n is a, c, g, or t
  modified_base (346)..(346): a, c, t, g, unknown or other
  misc_feature (346)..(346): n is a, c, g, or t
tcagctcgcgtgtccacgaccggtgctcgatttagagctcacgtattgggtttgggggagaactgctcagttaggacccagacggaaccatggaagccccagcgcagcttctcttcctcctgctactctggctccagagatcattggagaagtggtgatgacacagtctccggtcaccctgtctgtttttccnggggagagagccacctctctgtgcggccagtcagagcgttaggacgtaacttagcctggtatcagcagaggcctggccaggctcccagactcctcattcctttggccgtcctttaacgnggccaggtggaactcccgagccaggttcagcggngagtgggtctagggactttcgtacactctcacctataccaaataacctgactaatcgtcgaacgtactttgacttagtttactttctgtacagtctagttctagtaacgtcgtacggtccgtttctaaccggtttcggacggggtaacgggaaccgtaaaggggttcggtaaacctaccgtaaaacgtacgttacggtacggtcgtacggacctacccgacgtttcctagtttaccttcgacgtttacccgttccccgtacctagtttacccg

SEQ ID NO: 5708 - DNA, 578 bp, Homo sapiens
  misc_feature: GYAE6OF02JJ0SN.8.28.C06.1.454.CMB.1.raw
  modified_base (198)..(198): a, c, t, g, unknown or other
  misc_feature (198)..(198): n is a, c, g, or t
  modified_base (262)..(262): a, c, t, g, unknown or other
  misc_feature (262)..(262): n is a, c, g, or t
  modified_base (319)..(319): a, c, t, g, unknown or other
  misc_feature (319)..(319): n is a, c, g, or t
  modified_base (389)..(389): a, c, t, g, unknown or other
  misc_feature (389)..(389): n is a, c, g, or t
  modified_base (413)..(413): a, c, t, g, unknown or other
  misc_feature (413)..(413): n is a, c, g, or t
tcagctcgcgtgtccacgaccggtgctcgatttagagctcacgtattgggtttgggggtagggaacgtgctcagttaggacccagacggaaccatggaagccccagcgcagcttctcttcctcctgctactctggctcccagagatcattggagaagtggtgatgacacagtctccggtcaccctgtctgtttttccnggggtagagagccaccctctcctgtgcggccagtcagagcgttaggacgaacttagcctggtancagcagaggcctggccaggcctcccagacctcctcattctttggcctacctttaacngggccagtggaatcccagccaggttcagcgcagtgggctgggacttcgtcactctcaccatacaataccngcaatctgactacttgctagtttntttctgtcagctacgtctagaagtcgtggtccgttctaccgtttcgggacgggtacgggacctaagggtcggaacctacgaaaccgtaacgtggtacggacgtcgaccgaactacgttcgtacggttcctttactaccgttccttacccccggcctaacgttccg

SEQ ID NO: 5709 - DNA, 783 bp, Homo sapiens
  misc_feature: GYAE6OF02IEEQV.8.28.C06.1.454.CMB.1.raw
tcagctcgcgtgtccacgaccggtgctcgatttagagctcacgtattgggtttgggggagaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtcgcgccagtcagagcgttaaggacgtaacttagcctggtatcagcaggacggcctggccaggcctcccagacctcctcatcgtttggccgtcctttaacgcgggccaggtgaactccccgagccgtaggttccaggccggacgacgggttggggtacgtcgggggtactttccgttacctaacgttcctccctaacctaacttaccgtaaaacttaacccgttacggaacctaaagttccgttaacggtaaccgttaaccgttttcggacttttaaggttttacttttccgttagttaccgtaacggtccgtaacgttcggttaacgtaaacggtaccggtttcgggttaccgttttaccgtaccggggtttttccggaaccggggggtaaccgggtaaccgggtaaggggttacccggtaaacccgttaaacggtaaaaccggttacgttacgggtaccgggtaccgtcggtaaccctaacccggttaacgttcccgttacggtttaccctttaccgtacccgttttacccccgtttacccgtaccccgttatttaaccccgg

SEQ ID NO: 5710 - DNA, 580 bp, Homo sapiens
  misc_feature: GYAE6OF02HCZBH.8.28.C06.1.454.CMB.1.raw
  modified_base (314)..(314): a, c, t, g, unknown or other
  misc_feature (314)..(314): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcattctttggcctcctttaacgngggccagtcggactcccagccaggttcagcggcagtgggtctgggacttcgttcactctcaccatcaaactaacctgacaactctagacgtactttcgcttagtttattctgtctagtctagttctagagtacgtcggtccgtttacgtaccgtttcgggacggtacgggtaccgaacggttacggacctaacgaaaccgtacgttggcggtcgtgacctaccgtacttcgtacgtccttactacttccctcccgtacctcgtccg

SEQ ID NO: 5711 - DNA, 653 bp, Homo sapiens
  misc_feature: GYAE6OF02IAMKB.8.28.C06.1.454.CMB.1.raw
  modified_base (193)..(193): a, c, t, g, unknown or other
  misc_feature (193)..(193): n is a, c, g, or t
tcagctcgcgtgtccacgaccggtgctcgatttagagctcacgtattgggtttgggggagaactgctcagttaggacccagacggaaccatggaagcccccagcgcagcttctcttcctcctgctactctggctcccagagatcattggagaagtggtgatgacacagtctccggtcaccctgtctgttttcnggggagagagccacctctctgtgcggccagtcagagtcgttaagggaccgtaactttagcctaggtatccgagcaaggaggcctgggccaggcctcccagacctcctacatcgtttggccgttccttaacgacgggtccaggtaggaactcccgagccgtaggttcaggcggcgaggtcggggtctggggactttcggtacactctcacctatccaataactgacaatctacgtaacgttctttcggactttagtttactttcgtgtacagtacgtagttctagtaacggtacgtcggtccgtttacctacgggtttcggacggggaacggtaaccggtaacgggtccgtaaaccgtaccgtaaaccggttacgtcgggtaggtccgtacgaccctaacgtaccgttcgttacgttaccttcgttaacccgtttcccgttacccggtacctattacccgg

SEQ ID NO: 5712 - DNA, 550 bp, Homo sapiens
  misc_feature: GYAE6OF02GID3V.8.28.C06.1.454.CMB.1.raw
  modified_base (195)..(195): a, c, t, g, unknown or other
  misc_feature (195)..(195): n is a, c, g, or t
  modified_base (301)..(301): a, c, t, g, unknown or other
  misc_feature (301)..(301): n is a, c, g, or t
  modified_base (382)..(383): a, c, t, g, unknown or other
  misc_feature (382)..(383): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcncctttaacagggccagtggaatccagccaggttcagcggcagtgggtctgggacttcggtcactctcaccatcaataaccnncaatactcgacgtactttgtctagtttactttcttgtcagtctacttcgtagtaagtacttcggtccgttctacgtttccgggcggtagggaccgtaacgggtcggaccgtacgaaaccgaacgtgtcggcgtgacaccatctgtcttcactcttcccgtccatccg

SEQ ID NO: 5713 - DNA, 665 bp, Homo sapiens
  misc_feature: GYAE6OF02JYL61.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (462)..(462): a, c, t, g, unknown or other
  misc_feature (462)..(462): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagngccaccctctcctgtgcggccagtcagngcgttaggcgtaacttgcctggtatcagcagacggcctggccaggcctcccgagacctcctcattccttggcgtacctttaacgacgggtccacggttaggaaccttccccgaagccttagggttcacgggtcggcgtaggtcgggttccgtgggtactttcggttcacgttctccaacccattaccgtaaactacccgtgacgtaacttcgtacggtaactcctttacgngttaattttacttccgtagttccagtcgtacgttctagtaacgacgttcgggtacccgttccgttaggtttccgggaccgggtaagggtcccgtaaagggtcccggtaccaacggtaaactacgtggtacggtccgtactccgtacctaacgtttcgccgtttaccgttcctacctttacccgtccccggtacctagtttccg

SEQ ID NO: 5714 - DNA, 747 bp, Homo sapiens
  misc_feature: GYAE6OF02IBCSE.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagcccaccctctcctgtgcggccagtcagagcgttaggacgaacttagcctggtatcagcagaggcctggccaggcctcccagacctcctcatcgtttggccgtcctttaacgacggggcccaggtcggaacctcccgacgaccgtacggtcgacggcggacgtaggtcgggtcgtcgggtacctttcgtactactccgtaccaacctagtacctaaactaccgtacgtactaacgttccgtacggtaccgttacgtttacgtacgttttaagttttacgtttacgttcgtacgtacgttaccgtacggttacgtacggtaacgtaccggttccgggttacccgtttaccgtttaacccgggtttccgggtaaccggggtaacggggtaacccgggttaaacggggttacccggtaaccgtaaaccggtaaaccggtacgttacgggtacgggtaccgtaacggtacccgtaaccgttaccgttccgttacgtttacccttacgttacccgttcccccgtttacccgtaccctacgtttacccgg

SEQ ID NO: 5715 - DNA, 544 bp, Homo sapiens
  misc_feature: GYAE6OF02GS12I.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcggttaggacgaacttagcctggtatcagcagaggcctggccaggctcccagactcctcgatcttggcgcctttaacgagggccagtggaatcccagccaggttcagcggcagtgggtctgggacttcggttcacgtctcacctatcaataacctgacaatctgacgtactttgctagtttattctgtcagctagttctagaacgtcgtacggtccgttctaccgtttcggcgggtacggaccgtaggtcggactacgaacgtactggtgacgtgcaccgtatcgtgtcttcattccttccgcctagtccg

SEQ ID NO: 5716 - DNA, 655 bp, Homo sapiens
  misc_feature: GYAE6OF02G1BL9.8.28.C06.1.454.CMB.1.raw
  modified_base (316)..(316): a, c, t, g, unknown or other
  misc_feature (316)..(316): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgtaacttagcctggtatcagcagaggcctggccaggctcccagacctcctcattctttggcctacctttaacgngggccagtacggaactcccgagcctaggttcaggcggctaggtgggtctggggtacttcgtcactctcacctatactaaatacctgactaactctacgtaccgtactttcgacttagttttactttcgtacgtacgtagtctacgttcgtacggaacgtacgttcgggtccgtttacgtaccggttttaccggggacggggtaacgggtaaccgtaaggggttaccggtaacccttaacgaaaccgtaaccgttggtacggtaccgtacggtaccctaaccgtacttccgttccgttaccttccgtaaccttcccgttaccccgtacctacgttaccgg

SEQ ID NO: 5717 - DNA, 581 bp, Homo sapiens
  misc_feature: GYAE6OF02GGWJC.8.28.C06.1.454.CMB.1.raw
  modified_base (196)..(196): a, c, t, g, unknown or other
  misc_feature (196)..(196): n is a, c, g, or t
  modified_base (326)..(326): a, c, t, g, unknown or other
  misc_feature (326)..(326): n is a, c, g, or t
  modified_base (420)..(420): a, c, t, g, unknown or other
  misc_feature (420)..(420): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggccctggcccaggcctcccagtacctcctcattccgttcggccgtacccgtttaaccgngggtaccctaggtcggaactccccgaggccgtagggttcaggccggtcaggttcggggtactgggtacttcgttcactctcacatcaatacctnacaatctagactactttgctagttttacttctgtcagtctagttctgaagtacgtcggtccgttctacgttcgggacggaggtaccgaaggtcgacctacgaacgacgtgtgccgtgccaccgtatccttgttccttactcttccgtccctccgtattccg

SEQ ID NO: 5718 - DNA, 537 bp, Homo sapiens
  misc_feature: GYAE6OF02F6Y92.8.28.C06.1.454.CMB.1.raw
  modified_base (501)..(501): a, c, t, g, unknown or other
  misc_feature (501)..(501): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaactcccagccaggttcagcggcagtgggtctgggacttcgtcactctcacctatcaactaacctgcaatctgacgtactttgctagtttatttctgtcagtcagtctgaagtctcggtccgtttctacgtttcgggcggtagggaccgtaagggtcgtaccctagaaaccgacgttggngcgtgaccaccatctgtcttcattctcccgctatcg

SEQ ID NO: 5719 - DNA, 680 bp, Homo sapiens
  misc_feature: GYAE6OF02HTPX3.8.28.C06.1.454.CMB.1.raw
  modified_base (197)..(197): a, c, t, g, unknown or other
  misc_feature (197)..(197): n is a, c, g, or t
  modified_base (312)..(312): a, c, t, g, unknown or other
  misc_feature (312)..(312): n is a, c, g, or t
  modified_base (413)..(413): a, c, t, g, unknown or other
  misc_feature (413)..(413): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagccaccctctcctgtgcggccagtcagagcgttaggacaacttagctggtatcagcagaggcctggccaggcctccagactcctcatctttggcgtcctttaacgngggccaggtggaactcccagctagggttcaggcggacgtaggtcgggtcgtgggtacctttacgttccaacttcctacaacctagtacctaaacttaaccngtacaacttcgtacgtacgttaactttggaccttagttttactttcgtacgtacacgtctagttacgtggtaaacgtacgttccgggaccgttttacgtaaccggttttcggggacggggtaacgggaaccggttaaacgggtcggtaacccgtaaccggtaaaaccggttaccgttgggtaccggtcttacggacccgtaactacgtttccgttacggttaccctttacggtacctttaccccgttccccgtaccgttattaccgg

SEQ ID NO: 5720 - DNA, 570 bp, Homo sapiens
  misc_feature: GYAE6OF02FFJR1.8.28.C06.1.454.CMB.1.raw
  modified_base (195)..(195): a, c, t, g, unknown or other
  misc_feature (195)..(195): n is a, c, g, or t
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggggagagagccaccctctcctgtgcggccagtcagagcgttaggacgaacttagcctggtatcagcagaggcctggccaggctcccagactcctcatctttggctcctttaacgnggccagtggaactcccagccaggttcagcggcaggtgggtctgggactttcggtcactcgacaccatcaataacctgacaatctgacgtactttgctagtttattctgtcagtcagttctagaacgtacgtggtccgttacgacgttttcgggacgggtacgggtaccgtaagggtcggtaacctcgaaaccgtacttggtcggctaggacctactacttccttgttaccttcgtacttccgttccccgctattaccg

SEQ ID NO: 5721 - DNA, 652 bp, Homo sapiens
  misc_feature: GYAE6OF02IYBY7.8.28.C06.1.454.CMB.1.raw
  modified_base (234)..(234): a, c, t, g, unknown or other
  misc_feature (234)..(234): n is a, c, g, or t
  modified_base (318)..(318): a, c, t, g, unknown or other
  misc_feature (318)..(318): n is a, c, g, or t
  modified_base (455)..(455): a, c, t, g, unknown or other
  misc_feature (455)..(455): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagattcattggagaagtggtgatgacacagtctccggtcaccctgtcttgtttttcctggggagagagccaccctctcctgtgcggccagtcagngcgttaggacgaacttagcctggtatcagcagaggcctggccaggcctcccaggacctcctcattctttggcgtcctttaacgngggccaggtcggaactcccaggccaggttcgaggcggacaggttgggtcgtggggtactttcggttcactctccaaccattaccaaacttaacctgacctaaatctagtacctacttttgcttagttttatttcgtntacacgactagtctagtaaggtactcgggtccgtttccgtaccggttttcgggaccgggtacgggaaccgtaacggggttccggaacccgtaacgaaaccggtaacgttggtcgggtaccgtcggaccctaaccgtacttaccgttcggttaccctttccgtacctttacccgttcccccggtactaaccgttccgg

SEQ ID NO: 5722 - DNA, 583 bp, Homo sapiens
  misc_feature: GYAE6OF02F428O.8.28.C06.1.454.CMB.1.raw
  modified_base (313)..(313): a, c, t, g, unknown or other
  misc_feature (313)..(313): n is a, c, g, or t
  modified_base (426)..(426): a, c, t, g, unknown or other
  misc_feature (426)..(426): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagactcctcatctttggcgtcctttaacgngggccaggtggaactcccagccaggttcagcggcaggtgggtctgggacttcgtcactctcaccatcaatacctgacaatctcgactactttgacttagttttattctgtacngtctagttctagaagtactcggtccgtttcacgtttcgggacgggtacgggaccgtaagggtacggaccctacgaaacgtacgttcgtacggcgttacggacctaaccgtacttcgttacgttcttccgtacttcccgttccccgacctacgttccg

SEQ ID NO: 5723 - DNA, 638 bp, Homo sapiens
  misc_feature: GYAE6OF02IPAFJ.8.28.C06.1.454.CMB.1.raw
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagcccaccctctcctgtgcggccagtcagagcgttaggacgaacttagcctggtatcagcagaggcctggccaggctcccagactcctcatctttggcgtccttaacngggccagtggaatccagccaggtcagcgnagtgggtcngggacttcgtcactctcacatcaatacctgcatctagacgtactttgctagtttattctgtctagctagtcgtagtaacgtacgtgggtacccgtttcctaaccgttttcggggaccggggtaaaggggaacccgtaaggggttacgggaaaccccgtttaccgaaaaaccggtaaaccgttgggtaccggggtaccgtacggacccgtaaccctacttaccgtttacggtttaccctttaccgttactttacccccggtttacccccggtacccttaacgttacccgg

SEQ ID NO: 5724 - DNA, 920 bp, Homo sapiens
  misc_feature: GYAE6OF02JS3EJ.8.28.C06.1.454.CMB.1.raw
  modified_base (490)..(490): a, c, t, g, unknown or other
  misc_feature (490)..(490): n is a, c, g, or t
tcagctcgcgtgtccacgaccggtgctcgatttagagctcacgtattgggtttgggggtagggtaacgtgactcgagttagggacccaggacggaaccgagtaggaaagccccgaggtccgcgagcctttcgtctttcctaccttgctacttctcggtcctccgaagtacgacttcgattcggaggaagtggtgatgacacagtctcccggtcacccgttgtcttcggttttccgtaaggggtacgaggagacccaccgtccctccgtagtcgccgggcccaaggtttacccaggagtaccggttacgggaaacgttaaccttttaggcccttgggtaactttccgaagtaacccgaagtaccgggtaccctagggcccgttaacgggccctacccgggacaacccgaacccgttcgtaaccttccggttttagggcccctaaaccggtttaccaacgggggtcctaggtaccgggtacttaccggaccncctacgggttaccaagggtccggttccaagggcgggttacctttgggggaacctttccgggtttacccaagggttccctaacggtaccctacggtaaccaaccggtttaaacccttcgggaaccttacgtacctacggtttaaccgggtaactttccgacgttacggttttaatttcccgtacgtttaccgacggttaaccgtcgggtttacgtcgttaaaacgggtccttaaccgggtttcccgtacgttcccggttaaccgggtcggttaaccgggtacggtaaacgttacccggaccgtttaccggaaactaaccggttcggttaacgggccgtaaaggggttacccacgggttacccgttaccgtaaaggttcccgtttaaccgtaggttccccggtaaccccgtttcccggaagttttccccggg

SEQ ID NO: 5725 - DNA, 666 bp, Homo sapiens
  misc_feature: GYAE6OF02IWAQP.8.28.C06.1.454.CMB.1.raw
  modified_base (196)..(196): a, c, t, g, unknown or other
  misc_feature (196)..(196): n is a, c, g, or t
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggcagtcagagcgttaggacgaacttagccgtgtatcagcagaggcctggccaggctcccagactcctcatctttggccgtcctttaacncgggccagtggaactcccagccaggttcaggcggcaggtgggtctcggggtaccttcggttacaccgttctacaccactacaaactaacctgactaaatctacgaacgtactttgaccttagtttactttcgtcgtacacgacttacgtctaggtaacgtaccgtcgggtcccggtttaccttaccggtttccggggtaccgggtaacggggtaaacccggaaggggttcggtaaacccgttacgtaaaacccggtaacgttacgggtcgggtaccttcggggacctacccgtacgttacccgttcgttaccgtttacctaccgtttacccttcccccggtacctccttaccgg

SEQ ID NO: 5726 - DNA, 584 bp, Homo sapiens
  misc_feature: GYAE6OF02ILYNU.8.28.C06.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
  modified_base (393)..(393): a, c, t, g, unknown or other
  misc_feature (393)..(393): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttcctgggganagagccaccctctcctgtgcggccagtcagagtcgttaggacgtaacttagcctggtatcagcagacggcctggccaggcctcccagacctccnctattcttggcgtccttaagcgggccagtcggactccagcctaggttcagcgcgagtcgggtctgggtaccttcgtcactctcaactatacgaatacngactatcgtacgacgtactttgacttagttttacttcgtgtctacgtctagtctagaacgtacgtcggtccgttcgtacgtttcgggacggtaacggaccgtaagggtcggtacctaacgaacgtacgtgtaggtctcgtaccacgtagttcctacgttccttacgtaccttccgtacccgctacgtaccg

SEQ ID NO: 5727 - DNA, 638 bp, Homo sapiens
  misc_feature: GYAE6OF02H2OAJ.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgttttccngggganagngccacctctcctgtgcggcagtcagagcgttaggacattagcctgtatcagcagagctcggccaggcctcccagacctcctcatcgtttcggcgtacctttaacgagggccagtggaactcccagccaggttcagcggctaggtgggtctgggtacttcgtcactctcacatacaataacctgacaactctacgacgttacttgtacttagtttactttctcgttcagtctagttcgtagtaacgtcgtacgggtcccgtttaccgtaccggttttcgggaccggggtaacgggaacccgtaaacgggttaccgggaacccttaaccggaaacggtaacgttacgggtacgggtaccgtggaccctaaccgtagttccgttacggttcctttacctaccgtttacccggtttaccccgaccgttacgttacccgg

SEQ ID NO: 5728 - DNA, 710 bp, Homo sapiens
  misc_feature: GYAE6OF02JPKJZ.8.28.C06.1.454.CMB.1.raw
  modified_base (193)..(193): a, c, t, g, unknown or other
  misc_feature (193)..(193): n is a, c, g, or t
  modified_base (334)..(334): a, c, t, g, unknown or other
  misc_feature (334)..(334): n is a, c, g, or t
tcagctcgcgtgtccacgaccggtgctcgatttagagctcacgtattgggtttgggggtagggaacgtgctcagttaggaccagacggaaccatggaagccccagcgcagctctctctcctgctactctggctcccagagatcattggagaagtggtgatgacacagtctccggtcacctgtctgtttttccnggggtagagagccacctctccctgtgcggaccagtccagagcgttaggaccgaactttagcctggtactcgagtcagaggcctggaccagggcctcccgagacctcctactacttcgtttcggccgtaccgttttaaccgngggtacccagttacgggaaacttcccccgaggcccgtaaggtttccaacggtccggaccgaggttcggggtacttcggggtactttcggttaccaacgtttcctacctaccgaattccgaaacttaaccctggaacctattaccgtcgaaaccgttactttgacgttagttttacttacgtacgttactagacttacgttacgtagaacgtacgtcggttaccgtttacgaccgtttcgggaccgggtacgggtaaccgtaaggggtacgtaccggtaaccaacggtaacgttgggttaggccgttcggtaacctaccgggtacttacggtacttcccgtttgacccgttaccgtttccccggaccttagttcccg

SEQ ID NO: 5729 - DNA, 577 bp, Homo sapiens
  misc_feature: GYAE6OF02HSQ1P.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatcttggcctcctttaacgagggccaggtggaactcccgagccaggttcaggcgcaggtgggtctgggacttcgtcactctcacatcaataacctgacaatctagacgtattgactagtttattctgtcagctagtctagaacgtacgtcggtccgttacgtacgtttcgggacgggtacgggaaccgtaagggtacgaccgtaacgaaacgtacgtggtacggaccgtcgacccacctacttccgtacgttaccttacgtaccttcccgttcccgacctactccg

SEQ ID NO: 5730 - DNA, 807 bp, Homo sapiens
  misc_feature: GYAE6OF02G3C7F.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggcctcccagactcctacacttcgtttcggccgtaccttttaaccgacggggtcccaaggttcgggaaacttccccgaacgtcccgtaagggttaccagggccgggccgtagggttcgggggttccgttacggggggtaccttttccggtttacctaaccttcccgtaccgaaccctacttacctaaaacttaacccgtgtaccaaacttccgtaggtaaccgttacttttcggtacttaagtttttactttcgttacggttaccgtacggtccgtaaggtttaccgtaaggtaaacggtaccggtttccgggtcccggttttacgttaacccggttttccgggggaccggggttaacggggtaacccgtaaagggggttaccgggtaaaccccgtaaaccgtaaaacccggtaacggttaccgggtacgggtaccgtccggtaacccgtaacccgtaacgttaccggttcggtttacccgttttacctaaccgtttcccccgtttacccccggtaccccttacgttacccgg

SEQ ID NO: 5731 - DNA, 693 bp, Homo sapiens
  misc_feature: GYAE6OF02JGNJO.8.28.C06.1.454.CMB.1.raw
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcacctgtctgttttccngggganagtagccacctctcctgtcgcggccagtcagagcgttaggacgaacttagcctggtatcagcagacggcctggccaggctcccagactcctctactcgttcggcctaccgtttaacgacgggtcccaggttacgggaacttccccgacgtaccgtacgggttccgaaggccgggtacaagggttcgggtacgttacggggacctttcggtacctaaccttctaccgacctaactaccgaaaccttacctcgtaactaacgtcctagaccgttaacgtttcgtacttacggttttactttgtaccgttactacggtactacgttacgtacggtaaactccggttcggttacccgttacgtaccggttttccgggacgggtaacgggaacgtaaggtaccgggtaacctacggaaacgtaccggttggtacggccgtacgacctacgtacgttccgtcgtttaccttcgtaccgtttccctcccggacttactccgg

SEQ ID NO: 5732 - DNA, 520 bp, Homo sapiens
  misc_feature: GYAE6OF02FN37T.8.28.C06.1.454.CMB.1.raw
  modified_base (429)..(429): a, c, t, g, unknown or other
  misc_feature (429)..(429): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagtcagtctgaanctggccgttcactttcgggacggtagggaccaagggtcgacctcaaacgactgtggctgcacatctgtcttcacttccttcccgcctatcg

SEQ ID NO: 5733 - DNA, 668 bp, Homo sapiens
  misc_feature: GYAE6OF02IE7RQ.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtcttgttttcctggggagagacgccacctctcctgtcgcggccagtcagagcgttaggacgaacttagcctggtatcagcagaggcctggccaggctcccagactcctcattccgtttggccgtcctttaacgacgggtccaaggtggaactcccgagccgtaacgggttcaggcggacgtacggtcggggttcgtggggtacctttcgttacaacgtcctacgaacctagtaccaaacttaaccctagactaaacttccgtacggaaccgttacgtttcgtacgttaagttttaactttctgttacgacgtccttaagtcgttaggaaacgtcgtacggttcccgttacttaccggtttcgggacgggaagggtaaccgtaacgggttacggaaccgtaacgaaaccggtacttggtaccggtactacggaccacctaagtccttacgttcttaccttaccgttcccgtacccgtacctactccg

SEQ ID NO: 5734 - DNA, 552 bp, Homo sapiens
  misc_feature: GYAE6OF02IT457.8.28.C06.1.454.CMB.1.raw
  modified_base (312)..(312): a, c, t, g, unknown or other
  misc_feature (312)..(312): n is a, c, g, or t
  modified_base (373)..(373): a, c, t, g, unknown or other
  misc_feature (373)..(373): n is a, c, g, or t
  modified_base (411)..(411): a, c, t, g, unknown or other
  misc_feature (411)..(411): n is a, c, g, or t
  modified_base (536)..(536): a, c, t, g, unknown or other
  misc_feature (536)..(536): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttagacgaacttagcctggtatcagcagaggcctggccaggctccccagactcctcatctttggcgtcctttaacgngggccagtggaactccagccaggttcagcggcagtgggctgggacttcgttcactctcacntacaataacctgcaactctgactactttgcttagtttntttctgtacagtcctagtcgtagaagccgttggtccgtttctacgtttcgggacgggtacgggaccgtaagggtcggacctaacaaccgtaactgtagcgtagaccactagtctcgtcttaccgnttccgtcccgcattcg

SEQ ID NO: 5735 - DNA, 514 bp, Homo sapiens
  misc_feature: GYAE6OF02ITCKB.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtgaatcccagccaggttcagcgcagtgggtctgggacttcgttcactctcaccatcaataacctgcaatctgactattgctagtttattctgtcagtcagttctagagactggtccgttcacgttttcggcggacgggaccaaggtcggacctaacaacgactgcgctgccacatctgtcttcatccttcccgcatc

SEQ ID NO: 5736 - DNA, 573 bp, Homo sapiens
  misc_feature: GYAE6OF02IG4ZA.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgtcctttaacgagggccagtggaatcccagccaggttcaggcggcaggtgggtctgggacttcgttcactctcacatcaactaacctgactaatctagacgtactttgcttagtttattctgtcagtactagtctagaacgtactggtaccgttctacgtttcgggacgggaacgggtaccgaagggtaccgacctacgaaacgtacgtcggtcggtactggaccaccgtattcgtcgttcttacctacttcccttaccccgcctacttaccg

SEQ ID NO: 5737 - DNA, 532 bp, Homo sapiens
  misc_feature: GYAE6OF02GSXXA.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcaggtgggtctgggacttcgttcactctcaccatcaatacctgcaatctgacgactttgctagtttattctgtcagtcagtctgaagactggccgttctacgtttcggcgggacgggtaccgaagggtcggaccgtacgaaacgtactgtgcgtggcctacatcctgtcttctacttccttcccgccatccg

SEQ ID NO: 5738 - DNA, 633 bp, Homo sapiens
  misc_feature: GYAE6OF02IZAS1.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (318)..(318): a, c, t, g, unknown or other
  misc_feature (318)..(318): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccacctctcctgtgcggcagtcagagcgttagacgaacttgcctggtatcagcagaggcctggccaggcctcccagtactccctntacttcctttggcctacctttaacgnggtaccaggtcggaactcccgagcccgtaggttccaggtccgacgtaggttcgggtcgtcgggtacctttcgtccacttcctaccaaccattacaaacttaaccgtgactaactcgtagaccgtatttcgcttaatttnttacngtactagtactagttctacggaatcgtcggtcccgttagtacgtttccgggacgggacggtaaccgtaacggtcggtaacctacgaaaaccgttagtcggtacggtctaggaccctaactacgttaccgttgtttccctacgttaccgttcccgttacccgacctcgtccg

SEQ ID NO: 5739 - DNA, 597 bp, Homo sapiens
  misc_feature: GYAE6OF02F1U0B.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagccaccctctcctgtgcggccagtcagagtcgttaggacgaacttagcctaggtactcagcagacggcctggccaggcctcccagactcctcattcgtttcgggccgtacccttttaaacgacgggcctaggtacggaactcccgagccgaggttcaggcggcgaggtgggtctgggtacttcgtcacttctacacctatacaaataccgtgactatctagactactttcgattagtttattctgtactagctagttctagtaacgtcgtcggtccgttctacggtttccgggacgggtacgggtaaccgtagggttacgacctaacgaaacgtacgtggtcgacgtcgaccacgtacttctcgttcttctaccttccgtccctctctcg

SEQ ID NO: 5740 - DNA, 593 bp, Homo sapiens
  misc_feature: GYAE6OF02IFAYE.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (421)..(421): a, c, t, g, unknown or other
  misc_feature (421)..(421): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgngggganagagccaccctctcctggtgcggccagtcagagcgttaggacgaacttgcctggtatacagcaggagcctggccaggctcccagactctcatctttggcgcctttaagaggccagtcggaactcccagccaggttcagcggcaggtggtgtgggacttgtcacgtctcaaccatcaactaacctgactaatcgtagacgttacttgactagtttattcngttcagtctagtcgtagaacgtacgtcggtccttacgttaacgttccgggacgggtaacgggtaccgaaacgggttcggaacctaccgaaaacgtaccgtaggtacggtcgtcggaccaaccgtattcctacggttcttactaccttaccgtccccgtaccctagttacccg

SEQ ID NO: 5741 - DNA, 621 bp, Homo sapiens
  misc_feature: GYAE6OF02JKNI1.8.28.C06.1.454.CMB.1.raw
  modified_base (321)..(321): a, c, t, g, unknown or other
  misc_feature (321)..(321): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagacgccaccctctcctgtgcggccagtcagagcgttaggacgaacttgcctggtatcgagcagaggcctggccaggcctcccagacctcctcagttcgtttcggctaccgtttaacgngggcctaggtcggaactcccgagccgtaggttcgacggcggacgtaggtcgggtcgtacgggtactttcgtctaccttactacgaccctataccaaactaaccgtgactaactcgtacggtactacgtttgacttagtttactttctcgtactagactacgtcgtagacgtcgtcggtaccttcgttacgttcgggacggtacgggtaaccgtaggtaccggtacctaacgtaacgtacgtcgtcggcgtgaccgtacctatcgtacgttcttacgtacttcccgttcccgactgtaccg

SEQ ID NO: 5742 - DNA, 590 bp, Homo sapiens
  misc_feature: GYAE6OF02F7QOJ.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgcctttaacagggccagtggaactccagccaggttcagcggcagtgggtctgggacttcgttcactctacaccatcaataacctgacaatctagactactttgactagtttattctgtacagtctagtctagaacgtactgggtacccgttcacgttttccgggacggtaaggggaaccgtaagggtcggaaccgttaaccgaaacgtaacgtaggtacggtaccgtggacctaaccgtacttccgtacgttcgttacctaccgtttccgttaccccgtcctattacccg

SEQ ID NO: 5743 - DNA, 583 bp, Homo sapiens
  misc_feature: GYAE6OF02JOJTL.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattggggtttggggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggcctcccagacctcctctattcgtttcggcctaccgtttaacgacgggccaggtcggaacctcccgagccgtaggttcacggccggtacgaggtcgggtcgtgggtacctttcgtcactctacaccatacgaactaccgtgacaatctacgactacttgacttagtttacttctagtcagtcagtctagacgtctggtccttcgtacgttcggacgggacggacgaggtcgacctacgaacgtactggtacgtctcgacctactacgttcgtcgtcttacgtacttcccgtccctacgtcttacgg

SEQ ID NO: 5744 - DNA, 733 bp, Homo sapiens
  misc_feature: GYAE6OF02IBF9F.8.28.C06.1.454.CMB.1.raw
  modified_base (724)..(724): a, c, t, g, unknown or other
  misc_feature (724)..(724): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggccgtcctttaacgcgggccaggtacgacctccgagaccgtaggttcaggccgggactagggtcgggtcgtagggtccgtttcgttacgtactccgtaccaacctactaacctaaacttaaccgtcgaactaacttccgtacggaaccgtttacgttttacggtaccgtttaaagtttttaactttccgtttacggttaccgtaacggttaccgttaaggttccgttaagggtaaacggttccggtttaccgggtcccgtttaccgttaccgggtttcggggaaccggggtaccgggtaaccggtaacgggtaccgggtaaccctaaaccggtaaaccgtaacgtcggttacggtacgtcgtaacccaccgtacgttaccgtttacgtacccgtttactacccgtttcccgttacccgtacccgtnttaacccgg

SEQ ID NO: 5745 - DNA, 856 bp, Homo sapiens
  misc_feature: GYAE6OF02GWJ2F.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgccaccctctcctgtgcggcagtcagagcggttaggacgtaacttagcctggtactcgagcagacggccgtggccaggcctcccgagtacctcctctacttcgtttcggaccgtacccttttaaacggacgggcccaaggttacgggaaacttcccccgaacggcccgttaaacggggtttcccgaaagggtcccgggtaccgtaacggggtttcggggggttccgtttaacgggggggtaacccttttttccggggtttaccctaaacccggtttcccgttaacccggaaaaccccgttaacgttaaccctaaaaacccgtttaaccccgttagggtaaacccttaaacgtttacccgttaaccggtaaaccggttaccgtttttacggtaacccgtttaagggttttttaaacttttcccgttacggttacctacggtaccgttaacggtttaccgtaggtaaaccggttacggttccggttacccggtttactacggttttccgggacgggtacgggtaacccgtaggggtaccgtaaccgtacgaaaaccgtacgttcggtacggccgtcggaccgtaacctacgtacgtttccggtacctttaccgtacccgtttcccgttaccccgtacccgtagttacccgg

SEQ ID NO: 5746 - DNA, 864 bp, Homo sapiens
  misc_feature: GYAE6OF02G19HK.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagcccagcgcagcttctcttcctcctgctactctggcctcccagagatcattggagaagtggtgatgacacagtctccggtcaccctgtcttcgtttttaccnggggagtagacgcctaccctctccttgtcgccgccagtcgagagtacgttaggaacgtaacgtagccgttggtactcgagcgaacggacggccgtcgggccacgggtccctacccgaaggtaccttccctacgtaacgtttccgtttcggggacccttacccggttttaaaaccgacggggtaccctaaaggttcgggtaaacccttaccccgacggtacccggtaacgggtttaccaacggggtccggtaccggtacgggttacggggttccgtacgggggttaaccttttccggggttacctaaccgtttcgtacccgttaaaccgtaacttaaccctaaaaaccggtttaacctcggtaaactaacgttacgtacggtaaccgtttaacgttttccggaacgttacgttttacgtttccgtagttacctaacggttcgtacgtttcttaaggaacggtacgttaccgggttaccgttttaccgtaaccgggtttttcccgggaacgggggtacccgggtaacccgttaaaggggtcccgggttaaacccttaaacgaaaacccggttagttacggtccgggtacgtaccggtaccgtacggtaccttaccgtttaggttacccttccgtaacgtttcccgttaccccggacttaacgtttccg

SEQ ID NO: 5747 - DNA, 659 bp, Homo sapiens
  misc_feature: GYAE6OF02IHFKC.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (307)..(307): a, c, t, g, unknown or other
  misc_feature (307)..(307): n is a, c, g, or t
tcagctcgcgtgtccacgaccggtgctcgatttagagctcacgtattgggtttgggggaggaactgctcagttaggacccagacggaaccatggaagcccctagcgcagcttctcttcctcctgctactctggctccagagatcattgggagaagtggtgatgacacagtctccggtcaccctgtcttgttttccgngggganagacgcccaccctntcctgtcgcggccagtcagtcgtcgttaggactaacttgccgtaggtactcagcaggacggcctggaccaggcctccgagtacctcctanagttccgttggccttaccgtttaacggcgggcctaagggtacggaaccttcccgaggtccgtaggttccaggtccggcgaggttcgggtactgggtacctttcgtacacgttcctaccgactactaccgaaacgttaccgtgactaacgtccgtagtaaccgttacgtttcgaacgttacgttttactcgtaacgtcctagtcgtagttcgtacgtaacgtcgtccggtacgttcgacgtttcgggacggtacggacgtaacgggtctaccgtaacgaacgtactcggtacggtcctcggacctaacgtgttccgttacgtcgttactacgtcccgttcccgagtactccgg

SEQ ID NO: 5748 - DNA, 799 bp, Homo sapiens
  misc_feature: GYAE6OF02IDLCJ.8.28.C06.1.454.CMB.1.raw
tcagctcgcgtgtccacgaccggtgctcgatttagagctcacgtattgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctaccgaggggaaagagccacccgtctcctgcagggccagtcagaatgttggcgcctagtctcctaggtaccaacagaaacctggaccaggcctccaggccccctgactctagtggtcgctactaccaaacgacgggcctacgtacggcctactcccgaagccctaggttccaggtcgcgaggtgggtagtcgggactacggtaccttcgaaccttccgtaccacctagtcctaacttacgacggtaccccgttagggaacccgtcccgtagggtaacgggtacgttcgggtttacgtacgttaacggttttttaacgtaccgttggttaaaccccgaagttaccggtaccggttaaaccggtaggttacccggggttaccccgggtaccccggggggtaccctttaacccggggttttcccgggcccccgggtttaaagggggaaacccccgttaaaaggggttccggtaacgtttaacccggttaaaccggtaaaaaccccgggttaaccggtttcggggaaacccgggttccgttaacgggtaccccgtaacccgtaacggtttccggtacggtttttccccgtaaacgtttaccccggg

SEQ ID NO: 5749 - DNA, 657 bp, Homo sapiens
  misc_feature: GYAE6OF02IU40G.8.28.C06.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggggagagacgccaccctctccgtgtgcggccagtcagngcgttaggacgtaacttagcctggtatcagcagngctgcagcnccanctcnctatcgttggctacctttaacgcgggcctaggaggaactcccgagtccaacggttcgagacggcgtaggtcgggtcgtgggtacgtttcgtacgactctccacgtaatcaaacgttacctcgacaacttcgaggtacctagtttcgacttaggttttaactttcgtagttacgtaacgcgtaagttccgtaagtaacgtacgtacgggttccttacggttaccttttaccggggcgggtaaccggtaaccggttagaaccgggtacctaaacgtaaaccggacgtcggttaaggtccgtacgacccgtacgtaaccgttcgtaccgttacgttaccgtacctttacccgttacccggtccttacgtaccg

SEQ ID NO: 5750 - DNA, 619 bp, Homo sapiens
  misc_feature: GYAE6OF02H3OGO.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggcagtcagagcgttaggacgaacttagcctggtatcagcagaggcctggccaggctcccagacctcctcatcctttggccgtacctttaacgagggtccaggtcggaaactccccagccctagggttcacggcggcgtaggtggggtcgtgggtactttccgttcactctccaccatacaactaacctgctaatctcgacgtactttgacttagtttatttctgtacagtctagtcgtagaacgtcgtcggtccgttaccgtacgtttcgggacgggtaacgggtaccgtaagggtccggtaacctaccgaaacgtaccgtggtacggtcgtcggacctaccgtacgttcctacggttccttacgtacctttacccgttcccgtacctactacccgg

SEQ ID NO: 5751 - DNA, 696 bp, Homo sapiens
  misc_feature: GYAE6OF02ISUXL.8.28.C06.1.454.CMB.1.raw
  modified_base (168)..(168): a, c, t, g, unknown or other
  misc_feature (168)..(168): n is a, c, g, or t
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (638)..(638): a, c, t, g, unknown or other
  misc_feature (638)..(638): n is a, c, g, or t
  modified_base (667)..(667): a, c, t, g, unknown or other
  misc_feature (667)..(667): n is a, c, g, or t
tcagctcgcgtgtccacgaccggtgctcgatttagagctcacgtattggggtttgggggaggaactgctcagttacggacccagacggaaccatggaagccccagcgcagcttctcttcctcctgctactctggctccagagatcattggagaagtggtgatgacacngtctccggtcacctgtcttgttttccgagggganagcgcccacctctccttggcgccggacaggtcagacgtcggttagaacgtaacttacgcctggtactcgagcagcggtctggccaggtcctccagaccttttccntacttcgttcgacgtaccttaacggacggtccaaggttcgaaacgttcccgaagtccgtagggttccaggcggtacgtcgtcgggtcgtggggtacctttcggttacncgttaccncgaactagtacctaacttaacctgaacctacgttcgtacgtaaacgttcgtttagtactttaacggttttaacttcgttacgtcgttacgacgtttagtacgtaacggtaaacgttcggtaccgtttcggttaccctttacgggtttacgggaaccgggggtaacgaccggtaaggtccggtaacccaagtaaaaccgtcgtacggttcggtccncggttaccacgtatttccgtacgttaccncgttacctcccgttccgtacctgtaccgg

SEQ ID NO: 5752 - DNA, 620 bp, Homo sapiens
  misc_feature: GYAE6OF02JL3NN.8.28.C06.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (307)..(307): a, c, t, g, unknown or other
  misc_feature (307)..(307): n is a, c, g, or t
  modified_base (608)..(608): a, c, t, g, unknown or other
  misc_feature (608)..(608): n is a, c, g, or t
tcagctcgcgtgtccacgaccggtgctcgatttagagctcacgtattgggtttgggggaggaactgctcagttaggacccagacggaaccatggaagccccagcgcagcttctctttctcctgctactctggctcccagagatcattggagaagtggtgatgacacagtctccggtcacctgtctgttttccngggganagagccaccctntcctgtcgcggccagtcagagcgttaggacacttagcctggtatcagcaggagccgtggccaggctcccagactcctcatcttggcctaccttaancggccagtcggaactcccgagccgaggttcacggcgcgaggtcggggtcgtcgggtaacttcggttaccactccgtacaccgtataccaacttaacctgactaagtcctagacgtaactttcgacttagtttactttctcgtacgagtcgtagttccgtagtaacgtacgttcgggtaccgttacgtacggtttcgggacgggtacggggtacctaaacgggttcggacctaaccgaacggtactggtacgggtctacgggtaccacgtaatccgtattccttactcgttacccgtacccncgttattaccgg

SEQ ID NO: 5753 - DNA, 193 bp, Homo sapiens
  misc_feature: GYAE6OF02I8OYO.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtcttcgttttt

SEQ ID NO: 5754 - DNA, 807 bp, Homo sapiens
  misc_feature: GYAE6OF02H5EKC.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgtttttccnggggagagagccacctctcctgtgcggccagtcagagcgttaggacgaacttagcctggtatcagcagacggcctggccgaggcctcccgagaccttccctcaattccgtttcggccgtaccctttttaaacgacggggtacctaacgggtacggtaacttaccccgacggtcccgtaacgggtttccgaacggtaccgggacgtaagggttccgggggtcgtttgggggtaccctttaccggtttacaccgtttcctacctaaccgtatacccgtaaactaacccgtgaacctaataccgttacggaccgttaacgttttcgtaccgttaacgtttttaacgtttcgttacggttaccgtaggttacctaacggttacgttaacggaaacggttaccggttacgggtcccgtttaccgttaaccgggtttccgggtaaccgggggtaacggggtaccccgaaaggggtttaccgggaacccgtttaaccgtaaaaccggtacggttaccgggttaacgggcctaacggtaccctaaaccgtaccggtttaccttaccggtttacctttcgttaacccgtttccccgtttaccccggtaccctacgttacccg

SEQ ID NO: 5755 - DNA, 606 bp, Homo sapiens
  misc_feature: GYAE6OF02GUU9I.8.28.C06.1.454.CMB.1.raw
  modified_base (196)..(196): a, c, t, g, unknown or other
  misc_feature (196)..(196): n is a, c, g, or t
  modified_base (312)..(312): a, c, t, g, unknown or other
  misc_feature (312)..(312): n is a, c, g, or t
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
  modified_base (599)..(599): a, c, t, g, unknown or other
  misc_feature (599)..(599): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagagccaccctctcctgtgcggccagtcagagcgttaggacgtaacttagcctggtatcagcagaggcctggccaggctcccagacctcctcatcttggctccttaacgngggccagtgaactccgagccaggttcagcggcaggtgggtctgggacttcgtacactccncaccatcaaactaccngactatctagacgtactttgacttagtttactttctacgtacgtagcctagtctaggaacgtcgttcggtccgttcgttacggtttccgggacgggtaacgggtaaccgtaaggggtcggtacctaaccgaaaccggtacgttcgggtacggtaccgtcgaccctacctacgtccgttacgttcttacctacgttccccgttcctaccgtnttacccg

SEQ ID NO: 5756 - DNA, 660 bp, Homo sapiens
  misc_feature: GYAE6OF02JADL1.8.28.C06.1.454.CMB.1.raw
  modified_base (370)..(370): a, c, t, g, unknown or other
  misc_feature (370)..(370): n is a, c, g, or t
  modified_base (454)..(454): a, c, t, g, unknown or other
  misc_feature (454)..(454): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccaggggagagacgcccaccctctcctggtcgcggccagtcaggagtcggttaaggacgtaacttagcctaggtatcgaagcaggacggcctggccgaggcctcccagacctacctgtattcgttagccgtacctttaacgacgggaccaggtacggaactccaggccgagtcagcgnaggtggtcgtcggacttcgtcacgtctcaactatacctaactaccgtagactatctacgacgtacttagacttagttttacttntcgtacgtacgtacagttactaggaactacgtccggtaccgtttaccgacggtttacggggaccgggtaacgggtaaccgtaagggttaccgaaacccggtaaccgtaaaacgtcgtacgggtaacgtcgtaacgtaccggaccgttaacttacgtccggttacttaccgtaccgttacccgtttccccgtaccgtaccttaccgg

SEQ ID NO: 5757 - DNA, 623 bp, Homo sapiens
  misc_feature: GYAE6OF02JCE1O.8.28.C06.1.454.CMB.1.raw
  modified_base (195)..(195): a, c, t, g, unknown or other
  misc_feature (195)..(195): n is a, c, g, or t
  modified_base (582)..(582): a, c, t, g, unknown or other
  misc_feature (582)..(582): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagcccaccctctcctgtcgcggccagtcagcgcgttaggacgaacttagcctggtatcagcagaggcctggccaggcctccccagtacctcctctattcgtttgggcctaccttttaacgcgggtacctaggtacgggaactccccaggccctaggttccaggccggtcaggttcgggtctggggactttcgtcactctcaccatacaactacctgacaatcagacgtacgtttcgcttagtttatttcgtacgtcgagtctacgttcgtagtaacgtacgttcggtacccgttactaccggtttccgggacgggtacgggtaacccgtaagggtcgaacccttacgaaacgtacgtaggtcgacgttcgacctaccgngttcccgtgttaccttcgaccttcccgtcccgacctatccg

SEQ ID NO: 5758 - DNA, 664 bp, Homo sapiens
  misc_feature: GYAE6OF02HW0K3.8.28.C06.1.454.CMB.1.raw
  modified_base (194)..(194): a, c, t, g, unknown or other
  misc_feature (194)..(194): n is a, c, g, or t
  modified_base (361)..(361): a, c, t, g, unknown or other
  misc_feature (361)..(361): n is a, c, g, or t
tcagctcgcgtgtccacgaccggtgctcgatttagagctcacgtattgggtttgggggaggaactgctcagttaggacccagacggaaccatggaagccccagctcagcttctcttcctcctgctactctggctccagagatcattggagaagtggtgatgacacagtctccggtcacctgtctgtttttccgnggggagagagccaccctctcctgtcgcggccaggtcagagcgttaggacgacttagcctggtatcagacagaggcctggccaggcctaccagacctcctctacttcgtttcggcgtcctttaacgacggtcctagtcggaactcccgagccgtaggttccaggccgngtaacggtcgggtacgttcgggtacctttcggttactaccgttcgtccaaaccgtataccgtaaactaccgtacggtacctaaagttccgtagtaaccgttacgtttcggtacgttacgttttattaccggttgtacgtaacgtcgttagtaccgtaggtaacgtcgtacgggtccttacgtacgttcgggacggtacggtacgaagggtcgaccgttaacgaacggtatcggtacgtcgtacggacctacgtacgttaccgtgttccttaccgtacgttcccgtttcccgaccgtacgtccg

SEQ ID NO: 5759 - DNA, 656 bp, Homo sapiens
  misc_feature: GYAE6OF02I2KAV.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtgggggagagagcccaccctctcctgtgcggccagtcagagcgttaggacgaacttagcctggtatcagcagaggcctggccaggctcccagactcctcatctttcggctcctttaacgacgggccagtcggaactcccgagccgtaggttcacggcggcgtggtcgggtcgtagggtccttcgtttcacttctacaccactaccaaacttaaccgtacgtactaacgttcgtacgtaaccgttactttggtacgttaacgtttttactttacgttgtacctaggtcctaggttacttaggtaacgtaccgttcgggttcccgttacttaccggtttcggggacgggtacgggtaaccgtagggtccggaacctaacgaaaccgttacgtggtcggtaccgtggacccacgtactcgttacgttccttacgtaccttcccgttcccgaccttacgtccgg

SEQ ID NO: 5760 - DNA, 651 bp, Homo sapiens
  misc_feature: GYAE6OF02I7OX9.8.28.C06.1.454.CMB.1.raw
  modified_base (151)..(151): a, c, t, g, unknown or other
  misc_feature (151)..(151): n is a, c, g, or t
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
  modified_base (414)..(414): a, c, t, g, unknown or other
  misc_feature (414)..(414): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattgganaagtggtgatgacacagtctccggtcaccctgtcttgtttttccgnggggagagagccaccctctcctgtgcggccaggtcagagcggttagacgaacttgccttaggatcagctagaggcctcggcaggcctcccgagaccttcctntattccgtggcctacctttaacgcggtccagtggaactcccgagtccgagttcaggtcggcaggtggtcctgggcttcggttccacgttcctacaccatacctaataccccgtanaccgtaatccgtacgaaccggttactttggtaccgttaggtttttactttcgttacggtctaagtaccgtagttccgtagtaaacgtccgtttcggaccgttcccgttacgtttacgggaccgggaacgggtacgtaacgggttcgacccgtaacgaacgaaccgttgtacggtaccgtcggtaccacgtacctagttccgtccttacgtaccttccctcccgttacctattaccgg

SEQ ID NO: 5761 - DNA, 599 bp, Homo sapiens
  misc_feature: GYAE6OF02F771E.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccnggggagagcgccaccctctcctgtgcggccagtcagagcgttaggacgaacttagcctggtatcagcagaggcctgggccaggcctcccgagacctcctcattccgtttggcgtcccttttaacgaggggtcccaggtgggaactccccgaggccaggttcagcggcaggtgggtctgggtacttcgttcactctcaccatacaataacctgctaatctgactactttgcttagtttatttactgtcagtctacgtctagaagtacgtcgggtccgtttctaccgtttcgggacgggtacgggaccgtaagggtcgacctacgaaaccgtacgtagtcggcgtacggacctaccctagttccttacgttccttacctacgtttcccgttccccgtacctataccg

SEQ ID NO: 5762 - DNA, 784 bp, Homo sapiens
  misc_feature: GYAE6OF02JWZY2.8.28.C06.1.454.CMB.1.raw
  modified_base (234)..(234): a, c, t, g, unknown or other
  misc_feature (234)..(234): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagagccaccctctcctgtgcggccagtcagngtcgttaggacgaacttagcctggtatcagtcaggacggtcctggccaggcctacccaaggtacctccgtactacgttccgttttgggcccgttaccgtttaaaccggacggggtcccaaggtacgggtaaccttaccccgaggtcccgtaacggttccgaaggccggtacgtacggttcggggttcgttacggggtacctttttccggtacctaccgttaccgtccgtaacctaagttaaccctaaaacttaacccgtggtaaccctaaacgtttcccggtacgttaacccgtttaacgtttcggttaacgtttacgtttttacgtttccgttagttccgtaaccggtaccttaggtttccgtaaaggtaaaccgtacggttccgggtttacccgtttcggtaaccggttttcggggacggttaacgggggtaacccgtaaagggttacccgggaaccttaaaccgaacgttaaccgtgggtacggtccgtcgaaccgtactacgtcgtttacgttcttccgttaccgttctaccccgtactagtccgg

SEQ ID NO: 5763 - DNA, 528 bp, Homo sapiens
  misc_feature: GYAE6OF02F93H8.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (312)..(312): a, c, t, g, unknown or other
  misc_feature (312)..(312): n is a, c, g, or t
  modified_base (498)..(498): a, c, t, g, unknown or other
  misc_feature (498)..(498): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctntcctgtgcggccagtcagagcgttaggactaacttagtctggtatcagcagaggcctggccaggctcccagactcctcatctttggcgtcctttaacgngggccagtaggatccagccaggttcagcgcagtgggtctgggacttcgtcactctcacatacaatacctgcaatctgacgatttgctagtttattctgtcagcagttctgaagtctggtccgttctacgtttcgggcggacgggaaccgtaggtcgactacgaaacgactgtcggactgaccactntcgtcgtcttcgtacttcctcccgctatcg

SEQ ID NO: 5764 - DNA, 821 bp, Homo sapiens
  misc_feature: GYAE6OF02G27IN.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgccggccaggtcagagcgttaggacgtaacttgcctggtatcagcagaggcctggccaggctcccagtacctcctcacttcgttcggaccgttaccgtttaacgacgggtaccctaaggtacgggtaaactccccgaggtacccgtacggggtttaccaacgggccggacgtacgggttcggggtaccgttcggggtaaccttttccgggtttacctaccgttccgtacccgtaacccgtaacgttaacctaaacgtttaaccctcgaacctaaacgttcgtaacggtaaccgttaaccgttttcggacctttaaggtttttactttaccgtacggttaccgtaaggtccgttaacgtttaccgtaggtaaacgtacggttccggttacccgtttccgtaaccgttttccggggacgggtaacggggttaaccgtaaacggggttccgggtaaacccgttaacggtaaaacccggtacgttacgggttaccgggaccgttaaccgggtaacctaacccgttaacgttacccggtttaacggtttacccgttttacgtaacccgttttaccccggtttaccccctacgttaacgttaccccgg

SEQ ID NO: 5765 - DNA, 662 bp, Homo sapiens
  misc_feature: GYAE6OF02GJX73.8.28.C06.1.454.CMB.1.raw
tcagctcgcgtgtccacgaccggtgctcgatttagagctcacgtattgggtttgggggaggaactgctcagttaggacccagacggagccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggcctcccagacctcctctattcgtttcggccgtaccctttaacgacggggcctaggtacgggaactccccgagcccgtaggttcacggcggctagggtcgggtcgtgggtactttcggtcacttctccacctataccaaacttacctagactaactctacgacgttactttcgacgtagttttacttcgtgtaccacgtactagttcgtagaacgtaccggttcggtacccgtttccttacggttttccggggaccgggtacgggaacccgtaagggtcggaaacccttacgaaacccggtacgttgggtacggtccgtacgtacccgaacccgttacgttcgttacgttcctttaccgtactttccccgttacccgcctaaccg

SEQ ID NO: 5766 - DNA, 546 bp, Homo sapiens
  misc_feature: GYAE6OF02FXQBA.8.28.C06.1.454.CMB.1.raw
  modified_base (195)..(195): a, c, t, g, unknown or other
  misc_feature (195)..(195): n is a, c, g, or t
  modified_base (301)..(301): a, c, t, g, unknown or other
  misc_feature (301)..(301): n is a, c, g, or t
  modified_base (519)..(519): a, c, t, g, unknown or other
  misc_feature (519)..(519): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacaacttagcctggtatcagcagaggcctggccaggctcccagactcctcatctttggccncctttaacagggccaggtggaactcccagccaggttcagtcgcaggtgggtctgggacttcgtcactctcacatcaaatacctgacatctagacgtactttgactagttttacttctagtcagtctagtctagaagtctacgggtccttactacgtttcgggacgggtagggtaccaagggtcgaacctagaaacgtatcgtcggcgtacgacacctntactgtctcgtactcctcccgcatccg

SEQ ID NO: 5767 - DNA, 736 bp, Homo sapiens
  misc_feature: GYAE6OF02GTROK.8.28.C06.1.454.CMB.1.raw
  modified_base (196)..(196): a, c, t, g, unknown or other
  misc_feature (196)..(196): n is a, c, g, or t
  modified_base (313)..(313): a, c, t, g, unknown or other
  misc_feature (313)..(313): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtcttgtttttccgnggggagagacgccaccctctcctgtgccggccagtcagacggtcggttaaggacgtaacttacggcctggtatcgagacaggacggtcctggtcaggcctcccacggactcctactnttcgttcggcgttacctttaacgacgggcctaggtacgggaacctcccgacggtacccgtacgggtttaccacgggtcgggaccgtagggttcggggtccgtttacggggggtaccttttaccggtttccctaacctttcctaccaacccgtaacttaccaaacgttaacctagtacctaactacgtcggtacgtttactttgtacgtttagttttatttccgtagttcgacgtcgttacgtacgtaggtacgtaccgtcggttacccgttcgtaccggtttcgggacggggtaacggaaccggttacggggtaccgtaccgtaacggtaaacgacgttaggtaccggacgtacggacctaccgtacttaccgttagtttacccttacgttaccctttccggtaccccgttctacgttaccgg

SEQ ID NO: 5768 - DNA, 556 bp, Homo sapiens
  misc_feature: GYAE6OF02FQFOG.8.28.C06.1.454.CMB.1.raw
  modified_base (208)..(208): a, c, t, g, unknown or other
  misc_feature (208)..(208): n is a, c, g, or t
  modified_base (296)..(296): a, c, t, g, unknown or other
  misc_feature (296)..(296): n is a, c, g, or t
  modified_base (544)..(544): a, c, t, g, unknown or other
  misc_feature (544)..(544): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacacaaacctggccaggctcccaggcccctnatctatggtgcatccaacagggccactggcatcccagccaggttcagtggcagtgggtatgggacagacttcactctcaccatcatcagcctggagctgaagattgttagttagtttattactgtactaactatcgtaaccgtaggtcggtccgtccgggggtcctaccggtttccggcccgtcgggaccgtaagggtcggagtacgtacgaaacgtaacgtggtacggctcgacaccgtactcgttntcttcattcccg

SEQ ID NO: 5769 - DNA, 841 bp, Homo sapiens
  misc_feature: GYAE6OF02ITNM6.8.28.C06.1.454.CMB.1.raw
  modified_base (153)..(153): a, c, t, g, unknown or other
  misc_feature (153)..(153): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (268)..(268): a, c, t, g, unknown or other
  misc_feature (268)..(268): n is a, c, g, or t
tcagctcgcgtgtccacgaccggtgctcgatttagagctcacgtattgggtttgggggtagggaacgtgcgtcagttaggacccagacggaaccatggaagcccagcgcagctctcttcctcctgctactctggctcccagagatcattgganaagtggtgatgacacagtctccggtcaccctgtctgttttccnggggnagagccaccctctcctgtcgcggccagtcagagcgttaggacgtaacttgacctggtatcgagcagnggcctggccaggctcccgagtacctcctcgacttcgtttcggccgtccgttttaaaccgacgggtcccaaggtcgggtaaacttccccgaagccccgtaagggtttccaacggtcgggtccgaaggttcgggggtaccgttcgggggaaccgttttccgtttaccgtaaccgttccgttaccgtaaccccgtattacccgaaaacttaaaccccgttcggaacctaacggttaccttacgggtaaacccggttaacgttttaccggtacgttaaacgttttacgttttaccgtttacggttacctaacggttaccgtacggtttacttagggtaaacgtaaccggttccggggttaaccgttttacccgtaacccgtttttcggggaccggggtaaccgggggtaaccccgtaaagggggttaccgaaacccggttttacccgaaaaaccggttaacccgttacggggttaccggtacggtttaccggtaacccgacccggttaacgttaccgtttccgttaaccgtttccgtacccgtttaccctttaccccggtacccgtactttacccgg

SEQ ID NO: 5770 - DNA, 611 bp, Homo sapiens
  misc_feature: GYAE6OF02FVQI3.8.28.C06.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (363)..(363): a, c, t, g, unknown or other
  misc_feature (363)..(363): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgttttccnggggagagngccaccctctcctgtgccggccagtcagagcgttaggacaacttagcctggtatcagcaggacggcctggccaggcctcccgagtacctcctactattcgtttggcctacctttaacgcgggccaggtcggaactcccgagccgtaggttcaggcggngtaggtgggtctgggtacttcgtacactctcacctatacaaactacctgacctaatctagtacgtactttgcgttagttttacttcgtgtacaggtactagttacgtaggtaacgtcgttcggtccgttacgtacggtttcgggacgggtacgggacgtaagggtcgaacctacgaacgtctagggtcgcgtcgacctacctagttccgttcgttaccttcgtaccttcccgtaccctactacgtccg

SEQ ID NO: 5771 - DNA, 527 bp, Homo sapiens
  misc_feature: GYAE6OF02HIE33.8.28.C06.1.454.CMB.1.raw
  modified_base (156)..(156): a, c, t, g, unknown or other
  misc_feature (156)..(156): n is a, c, g, or t
  modified_base (197)..(197): a, c, t, g, unknown or other
  misc_feature (197)..(197): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (432)..(432): a, c, t, g, unknown or other
  misc_feature (432)..(432): n is a, c, g, or t
  modified_base (442)..(442): a, c, t, g, unknown or other
  misc_feature (442)..(442): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (521)..(521): a, c, t, g, unknown or other
  misc_feature (521)..(521): n is a, c, g, or t
tcagctcgcgtgtccacgaccggtgctcgatttagagctcacgtattgggtttgggggaggaactgctcagttaggacccagacggaaccatggaagcccagcgcagcttctcttcctctgctactctggctccagagatcattggagaagtggtnatgacactgtctccggtcacctgtctcgttttccagggganacgtcgccacctctctgtcgcggctagcagagtcgttaggactaattgctggancagnagngctggcaggctccagctcncatcgttgcgtcttacaggcngtggactccagcgtaggtcagcgtancgtgggtntaggnttcttcactctccaatnanaaacttaccngactaagtctagacgtatttcgcgtaatttcttctgacaaggtctggtacagaagctgaccgtttnacgttcgggngtaacggactagtcggacttagaaacgtgtnggtcngacctacacggttctcggttacttccactttcccgtcctaccngttccg

SEQ ID NO: 5772 - DNA, 612 bp, Homo sapiens
  misc_feature: GYAE6OF02HANEL.8.28.C06.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagngccaccctctcctgtgcggccagtcagagcgttaggacgaacttgcctggtatcagcagaggcctggccaggcctcccagactcctcatctttcggcctacctttaacgcgggccaggtcggaactcccgaggcctagggttcgaggcggcgaggtggggtctggggtactttcggtacacttcacaccataccaataaccgtgactaatcagacgtctttgacttagtttntttctgtcngtactagtctagaacgtcgtcgtccgttctaccggtttcgggacgggacggtaccgtaagggtccggtaaccctaacgaaaccgacgttggtacggtccgtaggaccctaccgtacttccgtagttccttaccgtaccttcccggtttaccccgacctacgttccg

SEQ ID NO: 5773 - DNA, 723 bp, Homo sapiens
  misc_feature: GYAE6OF02HIN2W.8.28.C06.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctgggganagagccaccctctcctgtgcggccagtcagngcgttaggactaacttagcctggtatcagcagacggcctggccaggcctcccagacctcctctacttcgtttcggccgtaccgttttaacgacggggcctaggtacggaactccccgaggcccgtaagggttccacgggcggtcgagggttcggggtacgttcggggtaacctttcggttacctacttaccgtaccaacctaacgttaaccaaacgtttaaccctacggtaacctaacgttacctacggtaaccgttacttttacggtaccttaggtttttactttcgtagttaccgtacgtacgtacgttacgtaggtaaacgtaccgttcgggttacccgtttaccgtacggtttccgggacgggtaacgggtaaccgtaagggtacggtacccgtaacgaaaccgtacgtcggtacggtaccgtacgaccgtacctaacgttccgttagttccttaccgtacgttaccccgttcccgtaccttcgtacg

SEQ ID NO: 5774 - DNA, 813 bp, Homo sapiens
  misc_feature: GYAE6OF02GOPQH.8.28.C06.1.454.CMB.1.raw
  modified_base (201)..(201): a, c, t, g, unknown or other
  misc_feature (201)..(201): n is a, c, g, or t
tcagctcgcgtgtccacgaccggtgctcgattttagagctcacgtattgggtttgggggaggaactgctcagttaggacccagacggaaccatggaagccccagcgcagcttctcttcctcctgtctactctggctcccagtagatcattggagaagtggtgatgacacaggtctccggtcacctgtcttggtttttccgnggggagagacgccacctctcctgtcgcggccagtcagagcgttaggacgtaacttgcctggtactcgaggcaggacggcctcggccgaagggcctccgagtacctcctactacttcgtttcgggccgttaacctttaacggacgggtcctaaggtcggtaaacctcccgaacggtccgtaacgggttccgaacgggccggtacgtacggttcggggtccgtacggggttacccttttccggtaccacgttacctaccaacccgtaataaccgtaaaacttacccgtagtaacctaacgttacgtaacgtaaaccggttaacgtttacgtaaccgtttaacggttttactttacgtcggttaccgtacggttaccgtacggtttaccgtaaggtaacgtaccgttccgggttaccgtttaccggttaccggtttacggggaccggggtaacgggtaaccgttaacggggtaccgtaaacccggtaacgtaaaaccggtaccggttacggtccggtaccggttaacggaccccgttaacggtacctttaccggttaccgtttaccgtttcccttaaccgttccccggtttacccgtacccgttaccttacccgg

SEQ ID NO: 5775 - DNA, 632 bp, Homo sapiens
  misc_feature: GYAE6OF02HBO83.8.28.C06.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctcccagagatcattggagaagtggtgatgacacagtctccggtcaccctgtctgtttttccgnggggagagagccaccctctcctgtgcggccagtcagagtcggttaggacgaacttgcctggtatcagcaggaggcctggccaggcctcccagaccttccnctattcgttcggccgtacctttaacgaggggcctaggtcggaactccccgaagtcccaaggttcacggcggctacggttcggggtctaggggcctttcggttacacgttctacaacctagtacaaacgtaacctgacaactcgtagacgtactttcgtacttagttttacttctacgtctagtctagttctagtaacgtacgtcggtaccgttcgtacggtttcggacgggtaggaccgtaacgggtacggaccttaacgaaaccgtacgtggtacggtcgtagacctacgtagttccgtagttcttacctacttcccgttcccgactactccg

SEQ ID NO: 5776 - DNA, 719 bp, Homo sapiens
  misc_feature: GYAE6OF02F13IF.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgtttttccnggggagagagccaccctctcctgtcgcggccagtcagacgcgttaaggacgaacttagccgttggatcagcagacggcctggccaggcctacccgagacctcctactattccgtttagggccttaccttttaacggacgggccctaagggttggaaaccttcccgaagtcccgtagggttacaacggtccggactacgggttacggggttctcggggtacctttcgggtaccctacttccgacaccgtaattacccaaacgtaaccctgacctaattccgtagtaacggtactttcgcttaaacgttttaactttccgtagtacacgtcgtaacgttctacggtaaaggtaccttcggggtccctttacggaccggttttacggggaccggtaacggggaaccgttaaggggtccgtaaacccttacgtaaaacggacgtttcggacggaccgttacgaccgtaactacgttaccggttcgtttaccttacgttaccgttcccgtttacccgacttacttcccgg

SEQ ID NO: 5777 - DNA, 661 bp, Homo sapiens
  misc_feature: GYAE6OF02I25ZA.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagacgcccaccctctcctgtgcggccagtcagagcgttaggacgaacgttacgcctggtatcagcagacggcctggccgaggcctcccgagacctccctacgtacttcgtttggccgtacctttaaccgacgggcctaggtacggtaactccccgacgtcccgtaggttcgacggcggacgaggttggggtacgttcggggtaccgtttcgttacctaccgttcctacgaacctacgtactaaactaacccgtgactaagtcttacggaaccgtttagttcgaccgttagttttactttcgtgtacaggtctagttcgataagactcggtccttcgtacgttcgggcggtaggaccgtaacgggtcgtaccaacgaaaccgtacgtggtcggacgttagccctaacgtactttccgtagttccgttactacgtttccccttacccgtccctagttccg

SEQ ID NO: 5778 - DNA, 754 bp, Homo sapiens
  misc_feature: GYAE6OF02IZX5K.8.28.C06.1.454.CMB.1.raw
  modified_base (315)..(315): a, c, t, g, unknown or other
  misc_feature (315)..(315): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagaggagccaccctctcctgtgcggccagtcagagcgttaggacgacttagcctggtatcagcagagcctggccaggctcccgagacctccgtcattctttcggcgtcctttaacgngggtaccaggtcggaaacttcccgaagtccgtagggttaccacggtcggacaggttcggggtacttggggaacctttcggttacacgttctaccaaccgtattaccgaaacgttaacccgtagtacctaacgttacctacggtaaccgttacgtttacggacttaacggttttatttacgttacggtcctaaggtcgtaacggtttccgtaagttaaacggaccgtttacgggtacccgtttacgtaccggtttttaccgggacggggtaaacgggtaacccgtaaaggggttaccggaaacccgttaaacggaaaccgtaaccggttagggtaccgggaccgttacgggaacccgtaaacccggtacgttacccgtttaacggtttcccgtttacgtacccgtttaccccgttaccccggtacccgttacgttaccgg

SEQ ID NO: 5779 - DNA, 798 bp, Homo sapiens
  misc_feature: GYAE6OF02H0BHV.8.28.C06.1.454.CMB.1.raw
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtctgttttcctgggganagngccaccctctcctgtgcgccagtcagagcgttaggacaacttgcctggtatcagcaggacggcctggccaggcctaccccgagtaccttccctacaacttcgttttcgggccgttaccttttaaaacgcggggcctaaggtcggaaacttccccgaagtcccgtaagggttaccgacggtccgggtaccgtagggttcgggggttaccgttcggggtacctttccggtttacctaaccttcctaccaacccgtaataccaaacttaaccgtcggaacctaacgttaccgtacggtaaccggttaccgttttacggtacctttaagtttttacgtttaccttacggttaccgtaacgttcgtacgttccgttaaggtaaacgtaccggttacgggttcccgtttaccggttaacccggttttccggggaccggggtaaccgggtaacccggtaacgggttaccggtaacccgttaaacgaaaccggtaaccgttcgggtacggtccgtaccggtacccgtaacccttaacgttccgtttacggttacccgtttaacctaccgtttaccccgttaccccccggtactacgttacccgg

SEQ ID NO: 5780 - DNA, 551 bp, Homo sapiens
  misc_feature: GYAE6OF02F45A4.8.28.C06.1.454.CMB.1.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (350)..(350): a, c, t, g, unknown or other
  misc_feature (350)..(350): n is a, c, g, or t
  modified_base (398)..(398): a, c, t, g, unknown or other
  misc_feature (398)..(398): n is a, c, g, or t
  modified_base (521)..(521): a, c, t, g, unknown or other
  misc_feature (521)..(521): n is a, c, g, or t
  modified_base (545)..(545): a, c, t, g, unknown or other
  misc_feature (545)..(545): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagacgccaccctctcctgtgccggccagtcagagcggttaggacgtaacttagccttggtatcagcagaggcctggccaggctcccagactcctcattcttggcncctttaacgnggccagtggaactcccagccaggttcagcggcnggtgggtcgtgggtacttcgttcacgtctcaccatctaactaaccgtnacatctagtacgtatttcgcttagtttatttctgtcagctagtcgtagagactcggtccgttcgtacgtttcggcgggaggacgtaggtacgacctaacgaacgtacgtggcgcgtgcaccgnttcgtatcttactcttccgtcccnctatcg

SEQ ID NO: 5781 - DNA, 716 bp, Homo sapiens
  misc_feature: GYAE6OF02HOXND.8.28.C06.1.454.CMB.1.raw
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgttcttgtttttccgtgggggagagacgcccaccctctcctgtgccggccagtcagagtcgttaggacgtaacttagccgtggtatcgagacagacggcctggccaggcctcccaagcctcctcattcgtttcggccgttacctttaacggacgggccaggttacggaactccccgaggcctaggttcgaggtccggacgtaggttcgggtactggggtacctttcggttccacgtctaccgaacctaagttacctaaacttaaccgtcggtacctaaagttctacggtaaccgttacgtttacgtacttacgtttttaactttcgttagttactaggtacttacggttacttaacgaaacgtacgtcgggttacccgtttacgtaccggttttaccgggaccggggtaacgggaaccgtaaacgggttaccggaaaccctaaacgtaaaccgtacggttacggtcggttaccgtctaccaccgtattaccgttgttacgttcctaccgttccctacccggtacttactccgg

SEQ ID NO: 5782 - DNA, 646 bp, Homo sapiens
  misc_feature: GYAE6OF02I06KA.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtcgcgccagtcagagcgttaggacgaacttagcctggtactcgagcaaggacggcctcgggccagggcctcccagacctcctcacttcgtttcggccgtacctttaacgcggggaccctaggtacggaactcccgagccgtaggttcacggcggctagggtcgggtcgtaggggtacctttcggtcctacgttcctacaaccctagtacctaaactaccgtgactaactcgtagacgtactttacgcttaagtttacttctcgtacagtcgtacgttctagtaacgtcgttcgggtcgttcctacggtttccgggacgggtacgggtaaccgagggtacggacccgtaacgaaacggtactcggtacgtacgcgtacctacgtacgtacgttgtaccttccgacttcccgtacccgtaccagttaccg

SEQ ID NO: 5783 - DNA, 689 bp, Homo sapiens
  misc_feature: GYAE6OF02JSD1F.8.28.C06.1.454.CMB.1.raw
  modified_base (151)..(151): a, c, t, g, unknown or other
  misc_feature (151)..(151): n is a, c, g, or t
  modified_base (493)..(493): a, c, t, g, unknown or other
  misc_feature (493)..(493): n is a, c, g, or t
  modified_base (514)..(514): a, c, t, g, unknown or other
  misc_feature (514)..(514): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattgganaagtggtgatgacacagtctccggtcaccctgtcttgtttttaccgtggggagtagagcccaccctctccgtggtacgccggcctagtcagacgtcgttaaggaccgtaaatttcgaccgttggtactcagcaggtagccgtaggccaggccttcccgagacctcctctagttcgtttgcgtacctttaacgacgggcctacggtggactcccgacgtccgtaaggttccgaggtacggcctaggttcgggtcgttacggggtactttcggttactaccgtctaccgtacctatacctaaacgtaccctgacctaagtccttaaggaacccgttcgttttanacgtttaggtttttacctttntacgttacaggttccttagtctaggtaaccgtcgtcggtaccgtttcgtacgtttcgggacggtaacggtaccgaaggttcggaaccctagaaccggtactgggttcgacgttacgccttaacgactttgtacggttaccctttcggactttccccggtactccctagtttaccg

SEQ ID NO: 5784 - DNA, 749 bp, Homo sapiens
  misc_feature: GYAE6OF02FWS45.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgccggcagtcagagcgttaggacgaacttagcctggtactcagcaggaggcctggccaggcctcccgagtacctcctcactcgtttcggcgtacctttaacgacgggccaaggtacggaactccccgagtcccgtaggttccgaggtccggacgaggttacggggtctacggggtacctttcggtttaccacgttcgtaccaacccgtacttacccaaacgtttaaaccctgaactaacgttaccgtacggtaaccgttacgttttcggtaccgttaacgtttttacgtttccgttacgttaccgtaacggtctaaggttaccctaggtaaacgtcgtacgggttccctttacggtaccggttttcggggaccggggttaacgggtacccgttaaaggggtccgtaacccgttaaccgaaaccggttaaccgttcggtacgggtaaccgtcgggtaacctaacccgtaagtttccgtacggtttccttaccgttaccgtttccccgtttaccccggccttacgttcccg

SEQ ID NO: 5785 - DNA, 666 bp, Homo sapiens
  misc_feature: GYAE6OF02JAV4F.8.28.C06.1.454.CMB.1.raw
  modified_base (449)..(449): a, c, t, g, unknown or other
  misc_feature (449)..(449): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgtggggagagagccaccctctcctgtcgcggccagtcagagcgttaggacgaacttagcctggtatcagcagaggcctggccaggcctcccagacctcctctacttcgttttcgggccgtaccctttaacgacggggccctaggtacgggaacttcccgagacccgtaggttccaggccggacgtagggtggggttacgtggggttacctttcggttccaccttcctaccgacctacgtacctaaaacgttaccngtaccaacttctacggtacgtactttcgtacttagttttactttctagtcacgtactacgttcgtagacgtacgtcggtccgttcgtaccgtttcggggacgggtacgggaaccggtaagggtaccggacctaacgtaaaccgtacgttacggtggtcgtcggacctaacgtcttcgtacggtttccttcgtacttcccgtcccgtacctcttacgg

SEQ ID NO: 5786 - DNA, 625 bp, Homo sapiens
  misc_feature: GYAE6OF02GE777.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (319)..(319): a, c, t, g, unknown or other
  misc_feature (319)..(319): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacgaacttagcctggtatcagcagaggcctggccaggcctcccagacctcctcattcgtttggccgtacctttaacgngggaccagtggaactcccagccaggttcagcgcaggtgggtctgggacttcgtcactctcaccatcaatacctgacaatctagactactttgcttagtttattctgtcagtctagttcgtagaacgtacgtcgggtcccttacgtacggttttcgggaccggggtaacgggtaaccggtaagggtcggtaaaccctaacggaaaccggtaacgttaggtcggtacgtacggtacctaccgtaacgttccgttacggtttcccttacgttaccgtttacccgttaccccgtaccgtacgttacccgg

SEQ ID NO: 5787 - DNA, 657 bp, Homo sapiens
  misc_feature: GYAE6OF02H0KQC.8.28.C06.1.454.CMB.1.raw
  modified_base (315)..(315): a, c, t, g, unknown or other
  misc_feature (315)..(315): n is a, c, g, or t
  modified_base (343)..(343): a, c, t, g, unknown or other
  misc_feature (343)..(343): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctccagagatcattggagaagtggtgatgacacagtctccggtcaccctgtcttgtttttccgtggggagagacgccaccctctcctgtcgcggccagtcagagcgttgggaacacttagcctggtatcgagcagacggcctggccaggcctcccagactctacatcttgcgtccttaacgnggccagcgactccacgcgagtcgagcgnaggtggtctaggactttcgtacactctacacctactactaactaaccgtagacttaactccgtacgtaaccgttacgtttcgaacgtttacgttttaactttcgtaggtactacgtacgtacgttacgtacgtaaacggtacgttccgggtaccgtttaccgttacggttccggggacggggtaacggtaacccggtaagggtacggaaactaaacggaacggtaaccgtggtaccggtacggtccgacccgtacctacgtttccgtacgttccttaccgtacccggtttccccgttaccacccgttactacgg

SEQ ID NO: 5788 - DNA, 729 bp, Homo sapiens
  misc_feature: GYAE6OF02I7TCT.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagagccaccctctcctgtcgcggccagtcagagcgttaggacgtaacttagcctaggtatcagcaggacggcctggccaggcctcccgagtacctcctctacttcgttttcggccgtaccgtttaacgacggggtcctaaggtcggaactcccgagccgtaggttccaggtcggactaggtgggtcgtcgggtacctttcgttcaccgttctaccacctactacctaaagtacccgtgtacctaacttccgtacgtaaccgttacgttttacgactttaacggtttttactttacgttacgtactaggtacgttaccgttacgtaggtaacgtaccgtcgggttacccgtttccgtaaccggtttcggggacgggtaaccgggtacgaacgggttacggtaacccgtaacgtaaaccggtacgttcgggtacggtccggtagtaccctaaccgtacgttacccgtttacgttcccgttacccgtaccgtttcccccgtttaccccggtacccgttacgttaacccgg

SEQ ID NO: 5789 - DNA, 640 bp, Homo sapiens
  misc_feature: GYAE6OF02GKRWG.8.28.C06.1.454.CMB.1.raw
  modified_base (365)..(365): a, c, t, g, unknown or other
  misc_feature (365)..(365): n is a, c, g, or t
  modified_base (389)..(389): a, c, t, g, unknown or other
  misc_feature (389)..(389): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctggtgcggccagtcagagtcgttaggacgaacttagccttggatcagcaggaggccgtggccacggcctcccgagacctcctctacttcgtttgggccgttacctttaacgacgggccagtggaactcccgagcctaggttcagcggngaggtgggtcgtggtacttcgtcnctctcacatcaatacctgacaactctacgactatttgacttagttttattcgttgtcagctacggttcagtaacgtcgttacgggtccgtttaccgtcggttttaccgggcgggtaacggggaacccgtaaggggttaccggaacccgtaaacgaaaccgtagttacgggtcggtcgtacggaaccgtaccctaacgttcccgtttgtttacccgttcgtacctttcccggttaccccacttaccgtccgg

SEQ ID NO: 5790 - DNA, 837 bp, Homo sapiens
  misc_feature: GYAE6OF02FYY6B.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagagccaccctctcctgtgcggccagtcagagcgttaggactaacttagccgtggtatcgagcaggacggcctggaccaggcctcccgagtacctccgtcattccgtttcgggccgtacccgtttaacgacggggccctaaggttacgggaaacttccccgaaggtccccgtaacgggttttccgaacggccggggtaccgaagggttcggggttccgttacgggggtaaccctttttccggtacccgtaccttccctacctaaaccccgtattaaacccaaacgtttaaaaccccgtggtaacccttaaaagtttccgtacggttaaccggttaacctttttacggtaccgtttaaacgggttttttaaccttttacgttacgggttaccctaacggttacccgttaacggtttctaagggtaaacgtacccggttccgggttacccggttttaccgtaccgggttttccggggaacccgggggtacgggtaacccggtaaggggttaccgtacccgttaacgaaaaccggtaaccgttgggtaccggacttcgggaccctaaccgttacgttccgtttacggttcccttaccgttaacccgtttcccgttacccccgtaccttctttacccgg

SEQ ID NO: 5791 - DNA, 873 bp, Homo sapiens
  misc_feature: GYAE6OF02IXTBT.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggagaactgctcagttaggacccagacggaaccatggaagccccagcgcagcttctcttcctcctgctactctggctcccagagatcattggagaagtggtgatgacacagtctccggtcacctgtcttgtttttccgnggggagagcgcccaccctctccgtgtgcggaccagtcagacggtcgttacggacgtaacttgcctggtactcagacgagacgggccctgggaccgacgggtcctacccctaggtacccttacccgtcttacgttccgttttcggcccgttaccttttaaaccggacggggaccgtaacggttacgggtaacctccccgaacggtcccggttaacgggtttacgaacggggtccccgggtacgtacgggggtttaaccggggggttccgtttaaccggggggtttacccgtttaccggttttacccgtaacccttttcccggtaccctaaacccgttaacttaaccctaaaaccgtttaacccgtacgtaaccttaacgttaccgtttaaaccgtaccggtttaccgttttagtaccgttttaggttttttaactttcgtacggtttacgaacttacgtaccgttacgttaacgtaaccggtacggttaccgggtttcccgttaaccgttcggtttacccgggggcgtaaacgggtaccgggtaacggttaaccgtaacccggtaagtaaaaccggttagtacgttagggtccgtaaccggtaccctaaacggttctttcccgtacggtttaccgtaccgttacccgttccccgtttcccggtaaccttccgttaccgg

SEQ ID NO: 5792 - DNA, 589 bp, Homo sapiens
  misc_feature: GYAE6OF02F589R.8.28.C06.1.454.CMB.1.raw
  modified_base (195)..(195): a, c, t, g, unknown or other
  misc_feature (195)..(195): n is a, c, g, or t
  modified_base (259)..(259): a, c, t, g, unknown or other
  misc_feature (259)..(259): n is a, c, g, or t
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatnagcagaggcctggccaggctcccagactcctcatctttggcgtcctttaacngggccagtggaatcccagccaggttcagcggcaggtgggtctgggactttcgtcactctacaccatccaaataaccctgacaatactgaccgtactttgctagtttatttactgtacagcagttctagaacgtactcgggtccgtttacaaccgttttcgggacgggtacgggaaccgtaaagggtcggaaccgtacaaaccgtaacgttgggtacggcgtacgaccaccacttacgttagtactttccgaacttacctttccccgaccctattaccg

SEQ ID NO: 5793 - DNA, 571 bp, Homo sapiens
  misc_feature: GYAE6OF02JH0VE.8.28.C06.1.454.CMB.1.raw
  modified_base (319)..(319): a, c, t, g, unknown or other
  misc_feature (319)..(319): n is a, c, g, or t
  modified_base (401)..(401): a, c, t, g, unknown or other
  misc_feature (401)..(401): n is a, c, g, or t
  modified_base (534)..(534): a, c, t, g, unknown or other
  misc_feature (534)..(534): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagcccaccctctcctgtgcggccagtcagagcgttaggacgtaacttagcctggtatcagcagagcctggccaggctcccagacctcctcacttctttggccgtcctttaaacgngggccaggtcgggaactcccagccaggttcagcgcaggtcgggtctggggacttcgttcactctcaccatacaaattaaccngcaacttctgacgtacttgctagtttattctgtcagtcagtctagacgtactcggtcgttctacggtttcggacggggacggtaccgaagggtcggaacctacgaaacgtaactgtaggtactgaccaacctntccgtcgttcttcaccttcctacccgacctagttccg

SEQ ID NO: 5794 - DNA, 662 bp, Homo sapiens
  misc_feature: GYAE6OF02GYFN1.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (404)..(404): a, c, t, g, unknown or other
  misc_feature (404)..(404): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctcggtcacctgtctgtttttccgngggganagacgccaccctctcctgtgccggccagtcagagtcgttaggacgtaacttgtctggtatcagcaggaggcctggccagggcctccccgagtacctcctcacttccgttcgggcctacccgtttaacggacgggtccaaggttacggaactcccaggccgtaggttacacggcggctaggtcgggtctcgggtacttcgtacnctcgtaccacacttacaacgttaacctgacctaactcgtagtaaccgttatttcggactttagtttattcgtgtacgtagctaggttactaggaactcgtcgtccgttcgttaccgttccggggacgtacgggtaaccgtaagggtacgtaaccgttaaaccgaacgtacggttcgtacgggtacgtcggtaccgacgttgttaccgttcgttacctttccggtaacctttcccgttccccgaccgttagttacccgg

SEQ ID NO: 5795 - DNA, 562 bp, Homo sapiens
  misc_feature: GYAE6OF02FT19L.8.28.C06.1.454.CMB.1.raw
  modified_base (371)..(371): a, c, t, g, unknown or other
  misc_feature (371)..(371): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagacgccaccctctcctgtgcggccagtcagagcgttaggacgaacttagcctggtatcagcagaggcctggccaggctcccagactcctcatctttggcgcctttaacagggccagtggaactccagccaggttcaggcggcaggtgggtctgggacttcggtcactcncacatacaatacctgacatctgacctactttgactagttttattctgtcagtcagtctagagtctgggtcccttcgtacgtttccggcgggtacgggacccgtaagggtcgactacgaaacgactggtcggaccgtgaccaccgtacgttcttacgttcctttactaccgtttcccgacctacttctacgg

SEQ ID NO: 5796 - DNA, 644 bp, Homo sapiens
  misc_feature: GYAE6OF02H3ZOJ.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtcgcggccagtcagagcgttaggacgtaacttagcctggtatcagcagaggcctggccaggcctcccagacctcctcatctttggctacctttaacacgggccagtcggaactcccgagcccgtaggttcaggccggcgtaggtcggggtcgtgggtaccgtttcgttacctacgtcctacacctataccgtaaataaccctgtacaattctcgtaacgttactttgtacgttagttttacgtttctgttacacgtctacgttactaggacgtacgtacggttccgttccgttaccgtttcgggacgggtaacgggaaccgtaagggtccggtaccctaacgaaccggtaactcggtcggtccgtcgaccgtaccaagtttcctcgtttcctaccgtacttccccgttcccctaccgtacttcgg

SEQ ID NO: 5797 - DNA, 588 bp, Homo sapiens
  misc_feature: GYAE6OF02HNSK0.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcagttggagaagtggtgatgacacagtctccggtcacctgtctgtttttccgngggganacgagccaccctctcctgtgcggccagtcagagtcgttaggactaacttagcctggtatcagcagagctggccaggctccagctctnatcttggcgtaccttaagcggaccagtggaactcccagtcagttcaggcgnagtggtcnggacttgtcactctcacatcaatacngacaatctagacgtactttgacttagttttacttctgtacagtcgtagttacctagaacgtccgtggtacccgtttagtaaccggtttcgggacggtaacgggtaaccgtaagggttcgggtaacctaacgtaaacgtcgttaggtacggcctaggaccctaacgtcgttacgttgttaccttacgaccgttcccgttaccccgcgtactcgg

SEQ ID NO: 5798 - DNA, 754 bp, Homo sapiens
  misc_feature: GYAE6OF02IRRW3.8.28.C06.1.454.CMB.1.raw
  modified_base (199)..(199): a, c, t, g, unknown or other
  misc_feature (199)..(199): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccgtcaccctgtctgttttctgggganagagccaccctctcctgtgcggccagtcagacgcgttaggactaacttagccgtggtaatcagcagaggcctggccaggcctcccagactcctcgacttcgtttcgggcgtacctttaacgacggggccaacggttaggaacttacccccgaaggtcccgaaggtttacaacgggcggactaggttgggggtccgttggggtacctttcggtttactacttcgtacaaccctataactaaactaaccctgacctaatcctagtaccgtacgtttacgtacttaagttttactttcgttacgtacgtaagtacctaggttaccgtagtaaaacggtacggttaccgggttacccgtttaccgtaaccgggttttcggggaacggggaaccggggggtaacctaaacgggggttaccggggtaaaccttaaacccggtaaaaacggtaaccgttagggtacggttaccgtagggtaaccccggaaaccttacgttaccggttagtttaccctttaccttacgtttaccccctttacccggacccttacttacccggg

SEQ ID NO: 5799 - DNA, 712 bp, Homo sapiens
  misc_feature: GYAE6OF02GW2OD.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagcccaccctctcctgtgcggccagtcagagcgttaggacgtaacttagccttggtatcagcagaggcctggccaggctcccagacctcctcacttcgtttggccgtccttttaacgacggggcctaggtggaactcccgagaccgtaggttcagcggcaggtgggtcgtgggtaccttcgttcactcgtacacctataccaaactacctcgactaatcgtacgaacgtcgttagaccttaggttttactttcgtcgtacgtagtcgtagtccgtagtaacgtaccgtcgggttacccgtttaccgtaccgtttaccggggtccgggtaacggggtaaccccggtaaagggggttaccggtaaccccggtaaccgtaaaaccggaaccggtttcgggtacgggtaccgttcggaaccccgtaacccgttacgttacccggtttacggttaccttttccgtaacccgttttccccggtttaccccggtacccgttaacggttaacccggg

SEQ ID NO: 5800 - DNA, 924 bp, Homo sapiens
  misc_feature: GYAE6OF02ICNDK.8.28.C06.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagctcacgtattgggtttggggaggaactgctcagttaggacccagacggaacatggaagccccagctcagcttctcttcctcctgctactctggctccagataccaccggagagattgtgttgacacagtctccagccaccctgtctttgtctcaggggaaagacgccaccctntcctgcacgggccagtcagagttcgttaaccacccgtagttacgccgtggtaacccaaacgaacctaaaccgtcggaccaacgggcctaccccgaacgggtccccctactaactttccgttttgacgttacgctacttacccgacttaccggaacggggcccctaacggtccggacctaaccttacccccgtaacggacccgtaacggggttttaccaacggggtcgggtaccgggtaaacgggtttcggggggttaccgttaaccggggggaaccgtaacggttacccgttttacccgaaaccttccgttaacccaaacccgttacttaccgacgtacccgtaacggtacccgttaacggacccgggtaacccgttaggtaaacgtttacgtttttacggaaccgttaagggtttttaactttaacgttacgttaaccttaaagtaacgttaaccgggttaacccgggtaacggttcccggggtaccccgggtttaccccgggggggttacccgtttaacccggttttcccggggtaccccgggtttaacgggggtaaaacccgttaaaacggtttaccggaaacgttaaccgtaaacgtaaaccggtaacggttttacgggtacgggttacctacggaccccgttaacgttaccgttacgtttacggtttccctttaaccgttacccgttttccccgttacccggttaaccc

SEQ ID NO: 5801 - DNA, 829 bp, Homo sapiens
  misc_feature: GYAE6OF02JS7F4.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtcttgtttttccgnggggtagagtacgcccaccctctccgtgtcgcggaccagtcagagcgttaggactaacttagccgtgtactcgagcgtaaggcggtccgtcggaccacggcctccaggtacctccgtactacgttcgtttcgggacccgtaccgttttaaacgacggggcctaaggtacggtaacctcccgaggtcccgtaagggttccgaaggtccgggacgtacgggttcgggggtaccgttaggggtaccgtttcggtttacccacgttaccgtactaacctatacccgtaaaacgttaccgtagtactaaacgttccgtaacgtaccgtttaacgtttcgtacgtttaacgttttcgtttaccggtacgttacccgtaagaccggtttaacggtccgtttaaagaacgggtttaccgtttacgggtaccccgttttagtaacccccgggtttcgggggtaaacccgggtaaaggggtaacccgtttaaacggggtacccggtaaaccccgtaacggtaaaaccggtaccgttacgggtaagggttccctaacgggcccgttaaaccttacggttccgttaacgggttcccctttaaccgggaccttttcccccggtcctaccgttacccgttaaccggg

SEQ ID NO: 5802 - DNA, 647 bp, Homo sapiens
  misc_feature: GYAE6OF02IACKZ.8.28.C06.1.454.CMB.1.raw
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (472)..(472): a, c, t, g, unknown or other
  misc_feature (472)..(472): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgttttccnggggganagagccaccctctcctgtgcggcagtcagagtcgttaggacgaacttagcttggtatcagcagaggcctggccaggctccagacctcctcatctttggcgtcctttaacgagggcccaggtggaactccagccaggttcaggcggcaggtgggttacgtgggacttcggttcactcgtccaccatacaacgtaactgactaatctcgacgttcttgacttagttttacttcgtgtcagtctgttactgtaacgtagtcgggtaccgttntaccggtttcggaccgggtaacgggaccgttaaacgggtcggtaaacctaccgtaaaccggtaaccgtagggttaccgggtacctacgggtaccctaaccgtaaccgttacgttcggtttacgttacccgtaaccggtttttaccccgtaccccggttccccgtagtttacccgg

SEQ ID NO: 5803 - DNA, 685 bp, Homo sapiens
  misc_feature: GYAE6OF02F9XUO.8.28.C06.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (266)..(266): a, c, t, g, unknown or other
  misc_feature (266)..(266): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctcggtcacctgtcttgttttccngggganagacgccaccctctcctgtcgcggccagtcagagtcgttaggacgaacttagcctggtatcagcagngcctggccaggctcccagacctcctctattctttcggctacctttaacgcggcctaggttggaactcccgagtccaggttcgacgcggcgaggttcggggtcgtggggtacctttccggttactacttccgtacaacctactaccgaaacttaacccgtgactaagttctacggtaaccgttacttttcgacctttaggtttttaactttcgtacgttcgtaacgttacgtaggttcctaaggtaacgtaacgttcgggttcccgtttaccggttaccgtttccggggacgggtaaccgggtaaccgtaacgggttaccggaacccgtaacgtaaaccggtacgtggtccggaccgtcgacgtaccctaagttccgttacgttaccgttctacttccccgttaccctacctattacccg

SEQ ID NO: 5804 - DNA, 585 bp, Homo sapiens
  misc_feature: GYAE6OF02HHV9B.8.28.C06.1.454.CMB.1.raw
  modified_base (355)..(355): a, c, t, g, unknown or other
  misc_feature (355)..(355): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttcctggggagagacgccaccctctcctgtgcggccagtcagagcgttaggacgtaacttagcctggtatcagcagaggcctggaccaggcctcccagacctcctcattcgtttggcctaccgtttaagcggaccagtaggaactcccagccgaggttcagcggngaggtgggtctgggacttcgttcactctacaccataccaaatacctgacctaatctacgtacgtactttcgtcttaagtttactttcgtgttcagtcgtagtctaggaacgtacgttcggtcctttcgtacgtttccgggacggaggtaccgtaaggtcggaactacgaaacgacgtcgtggactcgacacctagtaccgtgttaccgttcacttccgtacccgctatcg

SEQ ID NO: 5805 - DNA, 632 bp, Homo sapiens
  misc_feature: GYAE6OF02IBY11.8.28.C06.1.454.CMB.1.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
  modified_base (330)..(330): a, c, t, g, unknown or other
  misc_feature (330)..(330): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctcccagagatcagttggagaagtggtgatgacacagtctccggtcaccctgtcttgttttccgngggganagacgcccaccctctcctgtgcggccagtcagagcgttaggacgtaacttagcctggancagcagngcngcagccnccanctcntntcttcgctccttaagnggcaggtgactccagccaggtcnggcgcgtaggtgggcgtgggtcttcgtcactcctcaccatcaactacctcgactatcgtgtacgtctttgtacttagtttcgttactcgtctacgtactacgtagtacgtaacggtccgttggtaccggtttacctaccgggtttcgggtaaccggggacggggtaacccggttaagggtacccggtaacccgttaaaccgaaacggttaaccgtacggggtacggtaccgtacgtaacctaccgtaacttaccgttcgttcttaccggttaccctttccccgttacccgtaccacttacgg

SEQ ID NO: 5806 - DNA, 593 bp, Homo sapiens
  misc_feature: GYAE6OF02F24H5.8.28.C06.1.454.CMB.1.raw
  modified_base (403)..(403): a, c, t, g, unknown or other
  misc_feature (403)..(403): n is a, c, g, or t
  modified_base (447)..(447): a, c, t, g, unknown or other
  misc_feature (447)..(447): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcattctttggccgtaccttttaaacgacggggcccaggttcggaactcccagtcccaggttccaggcggcaggtgggtctgggacttcggtcactctcaccatacaataccgngaccaatctagacgtacttttgactagtttatttctgtacagcngtctagaagcgtggtccttcgtacgtttcggcgggtagggaccgtaagggtcggtaccctaacgaaacgtaacgtggcggtacgtcgacctacccgtattccgttagttaccttctaacgttcccttaccccggtcctacttaccg

SEQ ID NO: 5807 - DNA, 632 bp, Homo sapiens
  misc_feature: GYAE6OF02J1051.8.28.C06.1.454.CMB.1.raw
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
tcagctcgcgtgtccacgaccggtgctcgatttagagctcacgtattgggtttgggggaggaacgtgctcagttaggacccagacggaaccatggaagccccagcgcagcttctcttcctcctgctactctggctcccagagatcattggagaagtggtgaatgacacagtctccggtcaccctgtctgtttttccngggagagngcccacccgtcttccctgtcgccggccagtccaggagcggttaggacgtaacttagcctaggtatcagcagaggcctggccaggcctcccagcctcctcactcttaggcctacctttaacgcgggccaggtcggaactccccgagcctaggttcaggccggtactgtcgggtactgggtacctttcggtccacttctacaccacttcaaacttacctgactaaacgtcacgtactacctttgaccttagttttacttcgtagtcagtctagtctgaaagtctcggtaccgttactaccgtttcgggacggtaggtacccgtaagggtcgtaacccttagaaaaccgtacgtgacggtccgtacggtacccgtacctagttccgtagttacctcgtaaccttccgtttaccccgccgttaattcccgg

SEQ ID NO: 5808 - DNA, 619 bp, Homo sapiens
  misc_feature: GYAE6OF02G7ZR0.8.28.C06.1.454.CMB.1.raw
  modified_base (388)..(388): a, c, t, g, unknown or other
  misc_feature (388)..(388): n is a, c, g, or t
  modified_base (611)..(611): a, c, t, g, unknown or other
  misc_feature (611)..(611): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggactaacttagcctggtatcagcaggaggcctggccaggcctcccagacctcctcacttcgtttggccgtcctttaacgcgggcctaggtggaactcccagccaggttcaggtcggcaggtggtcgtgggactttcgtcactctcacnctacaatacctgacaatctaggaccgtatttcgacttagtttactttcgtacgttcaagtctacgttactacggtaagtaccgtcgggttccctttacgtaccggtttccgggacggggttaaccgggaccgttaagggtacgggtaccctaaacgggtaaacccgtacgttaggtcggtacgtcgaccgactacgttactgtaccttcgacttcccgtcccngtcttacg

SEQ ID NO: 5809 - DNA, 824 bp, Homo sapiens
  misc_feature: GYAE6OF02GGTW4.8.28.C06.1.454.CMB.1.raw
  modified_base (808)..(808): a, c, t, g, unknown or other
  misc_feature (808)..(808): n is a, c, g, or t
  modified_base (821)..(821): a, c, t, g, unknown or other
  misc_feature (821)..(821): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagactcagttggaagaagttggtatagtacggaccacgtacgtcctccggtccaaccccttggttccttggttttttccgtgggggtaccgaagggaacggaccgtaacccctccttccttcggtggccggtaccgacgtcctaggaggtaccggttagggtaaccgaacgttaccgaccgttagggtaccttcggaacgacgtaacgaacgggtacccttgggaccccaagggcccctaccccggaaggtacccttccccgttaccaactttaccgtttacgggaccgttacccgttttaaacgacgggtcccaaggttacgggaacctacccgtaggtacccgtacggttaccgacggtaccgggtcgtaaggttcggggtccgttacggggttaccgtttaccggttacgaccgttacgtacctaaccgtactaccgtaaacttaacccgtcgactaacgtccgtacgtacgttctttacgacgttaagttttacgttacgtagttacgacgtttaacttagtttcgacgtaaccgtccgttcgggttaacctttaccgtacgggttttcggaccgggtaaccggtccgttaaagtcccggtaaccgttaacgaaacccgtggtacgtacggtcgtacggaactacctaagtcgtacgttctaccnttcccgcctactntcg

SEQ ID NO: 5810 - DNA, 610 bp, Homo sapiens
  misc_feature: GYAE6OF02I0O51.8.28.C06.1.454.CMB.1.raw
  modified_base (198)..(198): a, c, t, g, unknown or other
  misc_feature (198)..(198): n is a, c, g, or t
  modified_base (573)..(573): a, c, t, g, unknown or other
  misc_feature (573)..(573): n is a, c, g, or t
tcagctcgcgtgtccacgaccggtgctcgatttagagctcacgtattggggtttggggaggaactgcttcagttaggacccagacggaaccatggaagccccagcgcagacttctcttcctcctgctactctggctcccagagatcattggagaagtggtgatgacacagtctccggtcaccctgtcttgtttttccnggggagagagccaccctctcctgtgccgccagtcagagcgttaggacgtaacgttagcctggtatcagcagaggcctggccaggcctcccagacctcctacacttccgttgggccgtccgtttaacgacgggtccaggtcggaactcccgagccgtaggttcgagcgcaggtcggtctcggtacttcgtcactcgtacacatacaactacctgactaactctagtacctacgtttgacttagttttacttcctagtcctagtctacgttcgacgaacgtaccgtcggtacccgttacgtaccgtttcgggacggacgggtaccgaagggtaccggacctaacgaaccgtacgtcgtacggtcgtcgactaccgtnttcgtcgttcttcgtaccgtccgtacccgtctactcg

SEQ ID NO: 5811 - DNA, 615 bp, Homo sapiens
  misc_feature: GYAE6OF02G1HLR.8.28.C06.1.454.CMB.1.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttcctgggganagagccaccctctcctgtgcggccagtcagagcgttaggacgtaacttagcctggtatcagcagaggcctggccaggcctcccagactcctctacttcgtttggccgtacctttaacgcggggcccaaggtcggaactccccgagacccgtagggttcacggtcgggctaggttcgggtacgtggggtacctttcggtttcacgttcctaccaacctataccaactacctgactaactctacgacgtactttgacttagttttacttcttgtacagtctagttctagaacgtacgtggtaccgttcgtacgtttcgggacggtacggaccgtaggtcggacctacgaacgtacgtgtcgtacgtgacctactagtcgttgttccgttctacgttcccgtcccgtactacgtccg

SEQ ID NO: 5812 - DNA, 602 bp, Homo sapiens
  misc_feature: GYAE6OF02GO5U7.8.28.C06.1.454.CMB.1.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcattcttggcctcctttaacgngggccagtcggaactcccagccaggttcagcggcagtggctgggacttcgtcactctcaccatcaatacctgacaatctgacgtactttgctagtttattctgtcagtctagtcgtagaagtcgtcggtcccgtttactaccgttttcgggaccgggtaacgggtacccgtaaggggttccggaacccgttaacgaaaccggtaccttgggtacggtaccgtcggtaccaaccgtacgttccgttaggttccttccgtaaccttcccgttccccgaccttacgttaccgg

SEQ ID NO: 5813 - DNA, 645 bp, Homo sapiens
  misc_feature: GYAE6OF02HAA0X.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcattctttggccgtccttttaacgacggggcctaggtcgggaaactccccgagccctagggttcaggcggcaggtcggggtctgggacctttcgtcactctccaccataccaataaccctgactaatctacgacgtactttgcttagttttacttctagtcagtctagttctagaacgtacgtcggtccgttactacgtttccggggcgggtaagggtaccgtaacggggttccggaaacccttaacgaaaccgtaacgttcggtacggtaccgtcggacctaacccgtagttccgttacggttccctttaccgtaaccgtttccccgttacccccgtacctaacttacccgg

SEQ ID NO: 5814 - DNA, 695 bp, Homo sapiens
  misc_feature: GYAE6OF02GCDEW.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctcggtcaccctgtctgttttccgnggggagagacgccacctctcctgtgcggccagtcagagcggttaggacgaacttagccgtggtatcgagcaggaggccgtggaccagggccctacccgaggtacctccctacatttccgtttcgggccgtacctttaacgacgggccctagggtacggaacctcccgaaggtccgtacgggttcaaggccggtcgtagggtcgggtcgtaggggtcctttccggttacaccgttctccgaacctacgtaaccgtaaacttaacccgtgaccgtaaacgttcctaggtaccgttacgttttcggtcgtttaacgttttactttccgtacgttcgtacggaccgtagttaccgtagtaacgggtcttaccgggtcccgtttacttaccgggtttcgggaccggggtaacggaaccggtaaggtccggaaacctaccgaacgtacgtggtcggtacgtcgactaccagttcgtgtccttacgacttcccgtccgacctgtaccg

SEQ ID NO: 5815 - DNA, 723 bp, Homo sapiens
  misc_feature: GYAE6OF02JSG3U.8.28.C06.1.454.CMB.1.raw
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
  modified_base (505)..(505): a, c, t, g, unknown or other
  misc_feature (505)..(505): n is a, c, g, or t
  modified_base (640)..(640): a, c, t, g, unknown or other
  misc_feature (640)..(640): n is a, c, g, or t
tcagctcgcgtgtccacgaccggtgctcgatttagagctcacgtattgggtttggggggagggaacgtggctcagttaggacccagacggaaccatggaagccccagcgcagcttctcttcctcctgctactctggctccagagatcattggagaagtggtgatggacacagtctccggtccacctgtctgtttttccgnggggtanagtacgcaccctctcctgtcgcgacagtcagcgtacggttaggacgtaacttacggcctaggttactacgagtcacggacggccgtgggcccgtaggcctaccccgaggtaccctcctactacttcgtttcggcctaccgtttaacgacgggtccaggtacggtaacctcccgaacggccgtagggttccaacggtcgggtactagggtcggggttcgtcgggttaccttggttcctacgtccttacgacctataccaacttaaccgtgactactcacgtacggttacttcgagtttntttaacgttctagttcgacgttacgtacgttccgtaaggtaacttacggtcggttccgttacgtaccgggtttacgggacgggtaacgggtaacggtacggttaacgggacccttaacgaaacggtacgttacgnggtaccgtacgggtactaaccgtgttccttaaggtttcccgttaactcccggtttacccgtaacccctgtaccgttaaccggg

SEQ ID NO: 5816 - DNA, 571 bp, Homo sapiens
  misc_feature: GYAE6OF02IDCPZ.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagcccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctccccagacctcctcatctttggcgtcctttaacgagggccaggtggaactcccagccaggttcagcggcagtgggtctgggacttcgtcactctcaccatcaaataactgctaatctagacgtaactttgacttaagtttatttctgttcaagtctagttctagaagtactcgggccgtttcaacgttttcgggacgggtaacgggaaccgtaaagggtcggaaacctaaccgaaaacgtaacgtgtaggtcgtgaccaaccatctgtcttcacttcctcccgtccatccg

SEQ ID NO: 5817 - DNA, 873 bp, Homo sapiens
  misc_feature: GYAE6OF02IJFKY.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagagcccaccctctcctgtgcggccagtcagagcgttaggacgtaacttagcctggtatcagcgagacggcctggccacggcctacccgacgacctcctactacttcgtttcggccgttaccctttaaaccggacgggtccgaaggttacggtaaacctaccccgaacggtacccgttaacgggtttaccgaacgggtccgggacgtaacgggttcgggggttaccgttacggggggttaacctttccggtttaccctaccgttaccttaccaacccgtaaactaacctaaaacttaaacccgtcggtaaacctaaacgtttacccggttaacgtaacccggtttaaccgttttacggtaccgttttaaggttttttaaccttttaccggtttacgttaccgtaacggttaccgttaacggttaccgttaagggtaaaccggttacccggtttaccggggttaccccgttttaccggttaaccggttttcccgggggtaaccgggggtaaacccggggtaaccgggtaaacggggttacccgggtaaacccgttaaaaccggtaaaaccggttaaccggttacgggtacggtaccggtacgaacccgtaaccgtacgttccgttacgttccttaccgttaccgttccccttcccgtacctacgttaccgg

SEQ ID NO: 5818 - DNA, 743 bp, Homo sapiens
  misc_feature: GYAE6OF02IEAHQ.8.28.C06.1.454.CMB.1.raw
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (687)..(687): a, c, t, g, unknown or other
  misc_feature (687)..(687): n is a, c, g, or t
  modified_base (693)..(693): a, c, t, g, unknown or other
  misc_feature (693)..(693): n is a, c, g, or t
tcagctcgcgtgtccacgaccggtgctcgatttagagctcacgtattgggtttggggaggaactgctcagttaggaccagacggaaccatggaagcccagcgcagcttctcttctcctgctactctggctccagagatcattggagaagtggtgatgacacagtctccggtcaccctgtcttgttttccgnggggangacgcctaccctctcctgtgcgcagtcagngtcggttaggaactaacgttcgcgtaggtactcgagcgaaggacggccgtcggccgaacggcctacccgacgtacctccctactattcgtttcggcccgttacctttaaacggcggtccaaggttcggaaaccttcccgaacggtcccgttaggggttccaacgggccggtacgaagggttcggggttccgtacggggttacctttccggtttacaaccgtttcgtaccctaaccttacgtaacccttaaaacgtaaacccgtttgaaccgttaaactttcgttaaccgggtaaccgttaacccgttttacggtaaccgtttaacgttttttaacttccggtttacgtaccgtacgttacgtacgttgtaacgtaacggtacgtccgggttacgtttacgtaacgggtttcggacgggtaacggaccggtaagggtccgaactacgaaacgtcgtacggngtacgngtaccacgtactctttacgtccttcacccgtttcctaccgtacctatcgg

SEQ ID NO: 5819 - DNA, 791 bp, Homo sapiens
  misc_feature: GYAE6OF02HK3JN.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagacgccaccctctcctggtcgcggcagtcagagcgttaggacgaacttagccgtggtatcagcgaggacggccgtgggccacgggcctccccgagtacctcctactacttccgtttacggaccgttacccgtttaaacggacggggtaccctaagggttcgggtaaacctaccccggaacggtcccgtaacgggttaccgaacgggccggtcggtaagggtttcggggggttccgttacggggggttacccgtttaccggtttacctaaccgttccgttaacccaacccgttaaccgtaacgtaaaaccttaaccgtttacgactaacgttaccgtagtaaccggttactttcgtacttaagttttacttacgttcgtacgtctacgtagtacgttaacgaagtccggttacggttccgttacgttacggtttaccgggacgggtaacgggtaaccgtaacggggtacggtaaacccgtaacgtaaaccggtcgttacgggtcggtaccgtacggaccaccgttaacgttacgttaccgttactttaccgtacctttacccggttacccctaccgttattaacccggg

SEQ ID NO: 5820 - DNA, 632 bp, Homo sapiens
  misc_feature: GYAE6OF02IZK7M.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtgggggagagagccaccctctcctgtcgcggccagtcagagcgttaggacgtaacttagcctaggtatcgaagcaggaggcctggccaggcctcccagactcctcatcgttggctcctttaacgcgggccaggtcggaactccacgccaggttcaggcggcaggtcgggtctaggggacctttcgtcacttctacaacctagcctaaagtacctgacaatcgtacgacgtactttgattacgttttatttaccttcgtactagtactagttacgtagtaaacgtcgttggtacccgtttacttaaccgttttcggggaccgggaacgggtacccgtaaggggtaacggacccttaaacgaaccggtaactgggttaggtctcggaccaacctacgtcgttcgttacttctaccttccgttacccctcctattaccg

SEQ ID NO: 5821 - DNA, 532 bp, Homo sapiens
  misc_feature: GYAE6OF02F19AD.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaactcccagccaggttcagcggcagtgggtctgggacttcgttcactctcaccatcaataaccctgacaactctgacgactttggctagtttatttctgtcagtcagttctgaagacttggccgtttctacgtttcggcggagggaccaagggtggacctacgaaacgactgacgctgccaccatcctgttctctactccttcccgcatccg

SEQ ID NO: 5822 - DNA, 752 bp, Homo sapiens
  misc_feature: GYAE6OF02H0D0W.8.28.C06.1.454.CMB.1.raw
  modified_base (165)..(165): a, c, t, g, unknown or other
  misc_feature (165)..(165): n is a, c, g, or t
  modified_base (194)..(194): a, c, t, g, unknown or other
  misc_feature (194)..(194): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacanagtctccggtcacctgtcttgttttccgnggggagagagccacctctcctgtgtggccagtcagagtcgttaggacgaattcgccttggtactcgagacaggacggccgtggaccagggccctacccgaagtacccttcctactacttccgtttcggaccgttacccgtttaacgacggggacccgtaaggtacgggtaaaccctccccgaacggtcccgttaagggttccgacgggtccggacgtagggttcgggggttcctttacggggggtaccctttttccggttaccgtaacccgttccgttaccctaaacccgtaattacccgtaaaactttaacccgcggtaacctaacgttccgtacggtaaacccggtttacgtttacggtacgtttaagttttttaaccttccgttcgttacgacgtaccgtagttactaaggtaacgtacgttccggtctttaccgtacggtttccgggacggtacggacgtaggtaccgacctagaacgtacgtggacgtcgtacgacctacgtcgttacgttcgttaccgttcttacccgttcccgttacccgtcctacttcgg

SEQ ID NO: 5823 - DNA, 695 bp, Homo sapiens
  misc_feature: GYAE6OF02HWUL4.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccacctctcctgtgcgcagtcagagcgttaggacgtaacttagcctggtatcagcagacgcctggccaggcctcccagacctcctcattctttggccgtacctttaacgacgggtccaggtcggaactcccgagcctaggttcacggcggcgagtgggtcgtgggtactttcggttcactcctacacctatacctaaacttaacctgactaattccgtacggtaaccgttacgttttcgtacttaagtttttaacgtttcgttcgtactacgttacctaggtttacgtaggtaaacgtcgtacgggttcccgtttacgtaccgggttttccgggaggggtaaccgggtaaccgtaaggggttaccggtaaaccctaacggtaaaacggtaccgttagggtacggtccgttaacgaccctaaccgtacttaccgttcgttacctttccgtaaccgttccccctttacccggacccttacgttacccgg

SEQ ID NO: 5824 - DNA, 600 bp, Homo sapiens
  misc_feature: GYAE6OF02FLH8D.8.28.C06.1.454.CMB.1.raw
  modified_base (195)..(195): a, c, t, g, unknown or other
  misc_feature (195)..(195): n is a, c, g, or t
  modified_base (285)..(285): a, c, t, g, unknown or other
  misc_feature (285)..(285): n is a, c, g, or t
  modified_base (551)..(551): a, c, t, g, unknown or other
  misc_feature (551)..(551): n is a, c, g, or t
  modified_base (595)..(595): a, c, t, g, unknown or other
  misc_feature (595)..(595): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgccggccagtcagagcgttagacgaattagcctgtatcagcagagctggccaggcctccgactccncatcgttggcctccttaacgcggccagtggaactcccgagccaggttcacgggcgctaggtggtctggtacttcgttcactcgtcacgtatacgaaactacctgactaatcgtacgactacgttcgtacgttaatttcgtttatcgttacgaacggtctacggttacgtagtaacggcgttgtcccgttacgttccggtttacgggccgggtaacgtaccggaaggttcggaacctacgaaacgacgtcgtacgctacggtaaccnccgtacgtctacgttcgttactacgttcccacccgtactacgtntacgg

SEQ ID NO: 5825 - DNA, 597 bp, Homo sapiens
  misc_feature: GYAE6OF02FO3NF.8.28.C06.1.454.CMB.1.raw
  modified_base (262)..(262): a, c, t, g, unknown or other
  misc_feature (262)..(262): n is a, c, g, or t
  modified_base (292)..(293): a, c, t, g, unknown or other
  misc_feature (292)..(293): n is a, c, g, or t
  modified_base (343)..(343): a, c, t, g, unknown or other
  misc_feature (343)..(343): n is a, c, g, or t
  modified_base (592)..(592): a, c, t, g, unknown or other
  misc_feature (592)..(592): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctggtcttgtttttccgtggggagagagcccaccctctcctgtgcggccagtcagagcgttaggacaacttagcctgttatnagcagaggcctggccaggctccagactccnnttcttcggcgcctttaacgcggccagtgactcccagcctaggttcagcgnaggtgggtctgggtacttcgtcactctccacactacaaacgtacagactaagtcctagtacctactttgacttagttttacttctcgtacagtctacgttcgagtaacgtactcgggttacccttcgtaaccggtttccgggcgggtaacgggtaaccgtaaggggttccgaacctaacggaaaccgtacgttggtacggtcctcggacctaccgtatcgttacgttcttctcgttcccttcccgactnttccg

SEQ ID NO: 5826 - DNA, 771 bp, Homo sapiens
  misc_feature: GYAE6OF02JACSK.8.28.C06.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
tcagctcgcgtgtccacgaccggtgctcgatttagagctcacgtattgggtttgggggaggaactgctcagtttaggacccagacggaaccatggaagccccagcgcagcttctcttcctcctgctactctggctcccagagatcattggagaagtggtgatgactacagtctccggtcaccctgtctgttttccnggganagagccacctctcctgtgcggccagtcagngtcgtagacgaacttagcctggtatcagtccaggaggccgtggccgaggccgtccccagacctacctctattccgttttacggccgttacccgttttaacgacggggtacctaacggttacgggtaaaccttcccccgaaggtaccccgtaacgggttttaccgaacgggttccgggacccgtaagggtttccgggggtaccgttcggggttaaccgtttccggttttcccgaactttccgtacccgtaaccgtacttaccgtaaaactacccgttcgtaacctaaacgttcgtacgtaaaccggttacctttttacgacgtttagtttttaaaccgtttccttacggttaccgacgttacgtagttacccgttagtaacgtaaccgtcggttacccggtttctaccggtttccgggacgggtacgggaccgtaagggtcggaacctaacgaacgttaacgtgtcggtacgtcgtacgaacctcgtaccgttcgttaacctttccgaaccgtttccctacccgtacccgtcttaacccgg

SEQ ID NO: 5827 - DNA, 566 bp, Homo sapiens
  misc_feature: GYAE6OF02GAHD7.8.28.C06.1.454.CMB.1.raw
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcctcctttaacgngggccagtggaactcccagccaggttcaggcggcagtgggtctgggacttcgtcactctcaccatcaataacctgacatctagacgactttgctagtttatttctgtcagtctagtctagaagtactggtccgttctacgttcggcggtacgggaccaagggtggaaccctacgaaacgtacgtacgtggtcgtggcctaccacgttctagttccttaccttaccttccgtttaccccgtacctagttacccgg

SEQ ID NO: 5828 - DNA, 584 bp, Homo sapiens
  misc_feature: GYAE6OF02F8G7R.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagccgttaggacgaacttagcctggtatcagcagagcctggccaggctcccgagactcctcatctttggctcctttaacaggccagtggaatccagccaggttcagcggcaggtggtctgggactttcgtcactctacaccatcaaactaacctgacaactctcgaacgtactttgctagttttacttctgtcagactagtactagaagtactcggtccgtttactacgtttcggccgggtaagggtaaccaagggttcgaaccctacgaaaaccgtacgtggtaggtaccgtgaccgacctagttccgttagttacctttcaacttcccgtttacccgacccgattacccgg

SEQ ID NO: 5829 - DNA, 584 bp, Homo sapiens
  misc_feature: GYAE6OF02FIZ6X.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (384)..(384): a, c, t, g, unknown or other
  misc_feature (384)..(384): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatcttggccnctttaacagggccagtcggaatcccgagccaggttcagcggnaggtgggtcngggactttcgtcactctcaccatcaataccngacaatcagacgtactttagcttagtttactttctagtcagctagtctaggaacgtacgtcgggtccgttacgtacgtttcgggacgggtacggaaccgtaagggtccgacctacgaaaccgtacgttcggacgctcggacctaacctgttacctcggttacttacgtaccttcccgttaccccgacgttaccttaccgg

SEQ ID NO: 5830 - DNA, 555 bp, Homo sapiens
  misc_feature: GYAE6OF02GE7VW.8.28.C06.1.454.CMB.1.raw
  modified_base (140)..(140): a, c, t, g, unknown or other
  misc_feature (140)..(140): n is a, c, g, or t
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (307)..(307): a, c, t, g, unknown or other
  misc_feature (307)..(307): n is a, c, g, or t
  modified_base (529)..(529): a, c, t, g, unknown or other
  misc_feature (529)..(529): n is a, c, g, or t
  modified_base (548)..(548): a, c, t, g, unknown or other
  misc_feature (548)..(548): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagngatccattggagaagtggtgatgacacagtctccggtcaccctgtctgtttttccngggganagngccaccctntcctgtgcggccagtcagagcgttagacgaattagcctggtatcagcagagcctgccaggctcccagactcctcatcttggccgctttaacgnggccaggtcgaactcccagcctaggttcaggtcggcctaggtcgggtctgggtaccttcgttcacgttctacgaccagtccaaataacccgtgacctaatcctgacgtacgtttcgacttagttttaattcgtgtcagctagttcgagagacgtcgggtaccttcacgtttcgggcggacggaccgaaggtcggactacaacggactagtggactggcaccntcctgtcttcatccgtccnctatacg

SEQ ID NO: 5831 - DNA, 706 bp, Homo sapiens
  misc_feature: GYAE6OF02IN3IG.8.28.C06.1.454.CMB.1.raw
  modified_base (193)..(193): a, c, t, g, unknown or other
  misc_feature (193)..(193): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcacctgtctgttttccngggagagagccaccctctcctgtgcggccagtcagagcgttaggacgaacttagcctggtatcagcgagacggccgtggccaggcctcccgagtacctcctctactcgttttcggcccgttacctttaaacgacggggtcctaggtacggtaacctaccccgaacggacccgtagggttccaacgggccggtcgtaacgggttcggggttaccgtacgggggttaacccgttttacggttaccctaacgttccctcctaacccgtaagtttaaccaaaaccttaacccgtacgtacctaaacttccgtacggtaaccgttactttcggtactttagttttactttcgttacgtcgtactacgtcgttacgtagaacgtcgttcggtcgttactaccggttcggacgggtacggtacgtaacgggtacgaccgtaacgaacgtcgtggtcgtctacggaaccactacttccgttcgttacttcctacccgttacccctccgtaccctagtccgg

SEQ ID NO: 5832 - DNA, 766 bp, Homo sapiens
  misc_feature: GYAE6OF02GOMZP.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagacgccaccctctcctgtgcggccagtcagagcgttaggacgtaacttagccgtaggtactcagcagacggccgtggaccaggcctaccccgaggtaccttcccgtacacgttccgttttgggcccgttaccttttaaaccggacggggtaccccgtaagggtacgggtaaaccttcccccggaacggtaccccgtaagggttccgaacgggtccggaccgtagggttcggggttcgttacggggtacctttccggtttccaacttcctacctaacccgtatacctaaaacgtaaccctgtaacctaagttccctaaggtaaccccgtacgttttacgacccgtttaggttttttaaccttcgttacgttacgacggttacgacgtttcgtacggaaacgttcgttccgggttcccgtttaccgtacggtttacccggggacgggaaccggtaccggtaagggtaccggtaacccgtaacgtaaaccgtaaccgtcggtcgggaccgtcgaacctaccgtagttccgtcgttctaccgttcctacccgttccgacttacgtacgg

SEQ ID NO: 5833 - DNA, 787 bp, Homo sapiens
  misc_feature: GYAE6OF02G81E5.8.28.C06.1.454.CMB.1.raw
  modified_base (234)..(234): a, c, t, g, unknown or other
  misc_feature (234)..(234): n is a, c, g, or t
tcagctcgcgtgtccacgaccggtgctcgatttagagctcacgtattgggtttggggagaactgctcagttaggacccagacggaaccatggaacgccccagcgcagcttctcttcctcctgctactcgtcggcctaccgaagagtatcgtagttagggaagtaaggtggtagactacgactacgtacgtccgtccggtacctaccgttgttacgtttcggttacggagggacnccgtaccgtacccgtcctccgtcgtcggtccgacgtacgtagtacgtaacgtacggtaacggttaacggtaaccgttacgttcgtacgtacgtacgcgacggtacgacggccgtaccgaccgtaccgtaccgtaccgtaccgtacgtaccgtaccgttcgttacgtcggtaccgtaacggttaccggtacgacgtacgtaccgtaccgtaccgtacgtacggtacgttacggtaccggtcggtacggtaccggttacggttcgtaccggttccttacctacgtacctaccgtaactaaccgtaactacgtaacgtacctacgtaacgtctacgttacgttaccgttacgttacgtttacgttacgttgtacgtacgtactagtacggttacgtacgtacggtcgtcgtaccgtaccggtacggtaccggtacggaccggtaacgtaccgtacggtacgtaacgtaacgtacgtcgtaccgtcgtacgtaccgtctaccgttcgtaccgttccgttaccgtaccttccgtaccgtccgtacgtacgtacgtacg

SEQ ID NO: 5834 - DNA, 810 bp, Homo sapiens
  misc_feature: GYAE6OF02IIKBQ.8.28.C06.1.454.CMB.1.raw
  modified_base (260)..(260): a, c, t, g, unknown or other
  misc_feature (260)..(260): n is a, c, g, or t
tcagctcgcgtgtccacgaccggtgctcgatttagagctcacgtattgggtttgggggaggaactgctcagttaggacccagacggaaccatggagccccagcgcagcttctcttcctcctgctactctggctccagagatcattggagaagtggtgatgacacagtctccggtcacctgtcttgttttccgtggggagagacgccacccttctcctgtgcggccagtcagagtcgttagacgtaacttgcctggtactnagcgagcggccgtcggccgacggcctacccgacgtacctcctctacttcgtttcggtccgttacctttaacggacgggtccgtaggtacggtaacctcccgacgtccgtacggttacgacggtcggtacgtagggtcgggttacgtacggggttccgtttcgtttactaccttaccgtaccaacctaaacttacctaaaacttaaccgtacgaaccttaacgttacgtacgtaaccgttacttttacgtacgttttaaggtttttactttcggtttacgttaccgtaacggtacttaacggttaccgtagggttaaacggttaccggttaccggggtttacccgttttaaccgtttacccggggtttcccggggtaccggggttaaaccggggtaaccggttaaacgggttaacccgggtaaacccgttaaaccgtaaaaccggttaccggttacgggtaccggtaccggtacgtaccctaccgttaacttccgtttacgtttcgttaccttaccgtttccccgtttaccccgtacccgttacgtcccgg

SEQ ID NO: 5835 - DNA, 703 bp, Homo sapiens
  misc_feature: GYAE6OF02II6WD.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcacctgtctgttttccngggagagagccaccctctccgtgtgcggccagtcagacgtcggttaggacgaactgcctggtatcagcagacggctggccaggcctacccgagactcctctagttcgttcgggccgtccgtttaaacgcggggtaccctaaggtacgggaaaccttccccgaacggtcccgtacgggttccacggccggacgtacgggttccggggtacgtcgggggtactttccggtccaccttctaccaccattacaaacttaaccctgactaacgttctacgtaacgtacgtttgtaccttagtttactttcgtagtcgtagtcctacgtcgttacgtaacgtcgttcgggttacccgttacgttaccggttccggggaccgggtaacgggtaacccggtaggggttaccgtaacccgtaaccgaaaccggttaacggttgtacgggtccgaaggtaccctacctaccgttcgttcgttaccttacgtacgttccccgtacccgtacctagtccgg

SEQ ID NO: 5836 - DNA, 589 bp, Homo sapiens
  misc_feature: GYAE6OF02HEYES.8.28.C06.1.454.CMB.1.raw
  modified_base (196)..(196): a, c, t, g, unknown or other
  misc_feature (196)..(196): n is a, c, g, or t
  modified_base (425)..(425): a, c, t, g, unknown or other
  misc_feature (425)..(425): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagagccaccctctcctgtgcgccagtcagagcgttaggacgaacttagcctggtatcagcagacggcctggccaggcctcccgagtacctcctctacttcgtttcgggccgtcccgtttaaacgacggggacctaggtaggaaactccccgagccgtaggttcacggcggcaggtcgggtcgtgggtaccttcgtcactctcaccatacaatacctgacatcngacgtcttgctattttactctgtcagtcagttctagaacgtctcggtcgttctacgttcgggacggtaggaccgtaaggtcgacctacgaacgtacgtgcggtccgtgacctaccgagttccgtacgttccttacgacctttccccgtaccccgctaccgttcg

SEQ ID NO: 5837 - DNA, 638 bp, Homo sapiens
  misc_feature: GYAE6OF02GP96F.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggggagagagcccacccttctccgtgtgcggccagtcagagcgttaggacgaacttagcctggtatcagcaggaggcctggccgaggcctcccgagacctccctcgacttcgtttggccgtacctttaacgacggggtccaggtcgggaactcccgagccgtacggttcgacggcggcaggttgggtcgtgggacgtttcgttcacgttctacacctactacaaacttacctgtactaacgtcctagaacgtacgtttgtacgttagtttatttcgtgttacgtagtcgtagttctagtaacgtcgtacggtccgttactaccgtttcgggacggtacgggtaacgtaacggtacggtacctacgaaaccgtacgtggtacggcgtcgacctaacgtcttacgttcgttacttcgtcttacccgttccgtacctcgttaccg

SEQ ID NO: 5838 - DNA, 794 bp, Homo sapiens
  misc_feature: GYAE6OF02GV1KA.8.28.C06.1.454.CMB.1.raw
  modified_base (233)..(233): a, c, t, g, unknown or other
  misc_feature (233)..(233): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttcctggggagagacgccacctctcctgtcgcggccagtcagngcgttaggacgtaacttagcctggtatcagcagagccgtggccaggctcccagacctcctctatcgttggcctccgttaacgcggccaggtacggaactccgacgtccgtacggttcacgcggacgtaggtcgggtcgtacggggtctttacggttacctacttccgtaaccaacccgtaactacctaaaaccgtttaccctacggtaacctaacgttacccgtaacgggtaaccgttttaaccgttttacggtaaccgttttaacgttttttaaacggtttcccgttaaccggttaccgtaacgtaccgtacggtttaacgtacggtaaaaccggtcggttaccgggttcccgtttacggttacccgggtttacggggaccggggtaaccgggtaaacccgggtaaacgggttacccgggtaaacccgtaaccgtaaaaccgggttacgggttacggtacccgggtacggttccggtaacccgtaacccgtaacgtttacccgtaacgtttcccgttacctaaccgtttcccccgttaaccggtcccttacgtacccggg

SEQ ID NO: 5839 - DNA, 609 bp, Homo sapiens
  misc_feature: GYAE6OF02HONKM.8.28.C06.1.454.CMB.1.raw
  modified_base (194)..(194): a, c, t, g, unknown or other
  misc_feature (194)..(194): n is a, c, g, or t
  modified_base (487)..(487): a, c, t, g, unknown or other
  misc_feature (487)..(487): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctccagagatcattggagaagtggtgatgacacagtctccggtcaccctgtcttgtttttccnggggagagacgccaccctctcctgtcgcggccagtcagagtcgttaaggacgaacttacgcctggtatcaggcagaggcctggccaggcctccagtacctcctcattcgtttggccgtacctttaacgacgggtcctaaggtcggaactcccgagcccgtaggttcgacggcggtataggtcgggtctggggtacctttcggtcactccgtacaccgtatacaactaacgtgtacaactcgtacgtactactttcgacttagttttacttctggtctagtactagtctagaancgtcgggtccttcgtacgtttcgggacggtagggtaccgaggtcggactaacgaacgtacgtggtcgtcgtcgacgtactacgttctcgttcttacctacgttcccgtcccgactagtaccg

SEQ ID NO: 5840 - DNA, 690 bp, Homo sapiens
  misc_feature: GYAE6OF02HFJI2.8.28.C06.1.454.CMB.1.raw
  modified_base (194)..(194): a, c, t, g, unknown or other
  misc_feature (194)..(194): n is a, c, g, or t
  modified_base (625)..(625): a, c, t, g, unknown or other
  misc_feature (625)..(625): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagagccaccctctcctgtcgcggccagtcagagacgttaggacgaacttagcctggtatcagcagaggcctggccaggcctccacgactcctcattcgtttcggccgtacctttaacgacgggccaggtcgaactcccgagccgtaggttcaggcggcgacggtgggtcgtgggtactttcgttcacgttctcgaaccactacaaacgtaacctcggactaacgtcgtacggtaaccgtacgtttcgtactttagttttactttccgtagtacctaggtactacgttcgtaacggtaacgtccgtcgggtacccgtttccttaccgggtttacggggacgggtaacgggaacccgtacgggtaccgggtacccttaacggaaaccgtacgttacgggtacgggtaccgtacggaccgtaaccgtnttacccgggttacttaccgtttccttaacgttcccccggtttacccctaccggttactacccggg

SEQ ID NO: 5841 - DNA, 815 bp, Homo sapiens
  misc_feature: GYAE6OF02G92ZP.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgttttccgtggggagtagacgccctaccctctcctggtgcggccagtcagagtcgttaggacgaacttagcctaggtactcagcaggacgccgtggaccgacggctcccagtaccctcctctattccgtttggccgtaccgttaacgacgggtacctaggtaggtaacttcccgagtacgtaggttaccaggccggtcgacggttcggggtaccggtacggggtaccgtttttaccggtaccaaccgtttccttaccgaacccttagtacccaaacgtttacccgttacgaaccttaagttaccgtcggtaaacccgtttacgttttacgggtacttttaaacggtttttacgtttaccgttacggttcccgtaaagttccgttaacgtttactaacgggtaaacgtaccgggttacggttccgtttaccggttaaccggttttccgggggaccggggttaacgggtaaacccggttagggttaacccgggtaaaccgttaaaccggtaaaccggtaacgttcggggttacgtacccgtaggtaaccctaccgtaacgttcccggttacggttttcccttaccgttaaccggtttcccccggtttacccctaccggttaccgtaccggg

SEQ ID NO: 5842 - DNA, 777 bp, Homo sapiens
  misc_feature: GYAE6OF02JPFRN.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttcttgtttttccgtggggagagacgccctaccctctcctgtcgccgcagtcagagtcgttaggacgtaacttacgctggtatcagcgagcggcctggccaacggcctacccgagaccttcctacgtacgtttcgtttcggccgtacccgtttaacgacggggtccctaggtcggtaaacctcccggaagtcccggtaacggttcgaacgggtccggacgtacggggttgggtcggttacggggtacttttccggtacctaccgttcctaccgaaccttaacgtaacctaaaccttaaccgtcgaactaacgttccgtaacgtaccgtttacgttttacggacgttttaagtttttaacgtttccgttaggttacctaaggttccgttacgttacgtaacggtaacgtccggttacggtttccttaccgtttaccgggttaccggggtaccgggtaacgggtaaccgtaaggggttcccgaaaccgttaacgggaaaccgttacgtcgggttacggtaccgtccgtacgacccgttacgttacgtttacctttaccgtacttaccggttacccttaccccgcttaccgttacgg

SEQ ID NO: 5843 - DNA, 664 bp, Homo sapiens
  misc_feature: GYAE6OF02H0AX5.8.28.C06.1.454.CMB.1.raw
  modified_base (419)..(419): a, c, t, g, unknown or other
  misc_feature (419)..(419): n is a, c, g, or t
tcagctcgcgtgtccacgaccggtgctcgatttagagctcacgtattgggtttggggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtggcgcagtcagagcgttaaggacgtaactgcctggtactcagcagaggcctggccaaggcctacccagacctcctacgaatcgtttaggaccgtaccctttaacgacggggtccagtcgggtaactccccgaagcccgtaaggttcaaggccgggtcaagggtcgggttctacgggtacctttcggtactaccgttccnctaccctaataccaaactaacccgatacctaatacctagaccgttactttagtaccgttaagttttacgttcttacgtctaacgtctagtcgttaagaacgtatccggtcgttactaccgtttcgggaccggtaaggaacgtaggtaccggaaactaccgtaaacgtacttggacggtaccgtgaacccgtacacgttaccgtgttaccacgttaccttaccggttacccctaccgtacttaccg

SEQ ID NO: 5844 - DNA, 768 bp, Homo sapiens
  misc_feature: GYAE6OF02HIBWG.8.28.C06.1.454.CMB.1.raw
  modified_base (192)..(192): a, c, t, g, unknown or other
  misc_feature (192)..(192): n is a, c, g, or t
tcagctcgcgtgtccacgaccggtgctcgatttagagctcacgtattgggtttgggggaggaacgtgctcagttaggacccagacggaaccatggaagccccagcgcagctctcttctcctgctactctggctcccagagatcattggagaagtggtgatgacacagtctccggtcacctgtctgttttccnggggtagagacgccacctctcctgtcgcgccagtcagagcgttaggacgtacttagcctggtatcgagcgagacggccgtggccagggccacccgagacctccgtacacttcgtttcggccgttaccgtttaacgacgggtcctaggttacggaaaccttcccgaaggcccgtaacgggttaccgaaggtccgggaacgacggttcggggtaccgtacgggggtaccttttcgggtttacctaccgttcctacgaaccctataccgtaaactaaccgtcgactaacgtctacgtaaccgttactttcgacgttagttttaactttccgttacgttcgaacggtccgttaacgttcgtaagggtaaacgttaccggttacggtcccgtttaaccgttaccggttttaccgggaaccggggtaaccgggttaaaccggtaacgggttaccgggaaacccttaacgtaaaacccgggtaacttccgggttaacggccgttaaccggaccgtaacccttaaggtcccgttcggttaccttcgtaaccgtttcccgttacccgttaccggtacttacccgg

SEQ ID NO: 5845 - DNA, 594 bp, Homo sapiens
  misc_feature: GYAE6OF02GE9ZA.8.28.C06.1.454.CMB.1.raw
  modified_base (201)..(201): a, c, t, g, unknown or other
  misc_feature (201)..(201): n is a, c, g, or t
  modified_base (316)..(316): a, c, t, g, unknown or other
  misc_feature (316)..(316): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagacgccaccctctcctgtgcggccagtcagagcgttaggacgaacttagcctggtactcagcagaggcctggccaggctcccagactcctcattcttcggccgacctttaacgngggcctaggtcggaactcccagcctaggttcagcggcagtgggtctgggacttcgtcacgtctcaccatcaaactacctgactatctacgacgtactttgacttagtttattctgtacgatcagttcgtagaagtactgggtccttagaccgtttcggacggtacgggaacctaagggtcgaaccttaacgaaagtacgtggtacgacgttcgaacctacgtaacttcgttcggtacctttacgtaacccgtttcccgtcccggtacctatttaccgg

SEQ ID NO: 5846 - DNA, 574 bp, Homo sapiens
  misc_feature: GYAE6OF02F41QW.8.28.C06.1.454.CMB.1.raw
  modified_base (319)..(319): a, c, t, g, unknown or other
  misc_feature (319)..(319): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (567)..(567): a, c, t, g, unknown or other
  misc_feature (567)..(567): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgtggggagagagccaccctctcctgtgccggcagtcagagcgttaggactaacttagcctggtatcgagcagacggcctggccaaggcctcccgagcctcctcattcgttggcgtcctttaacgngggccagtggaactcccagccaggttcaggcggcaggtgggtctgggtacttcgtcactcacacatcaataactgactatctgacactttncgtagtttattcngtacntagtactcgtagaagtctggtccgttacgttacgttcgggaccgggtaagggaacccgtaagggtccgtacctaacgaaacgaccttgggcgacgtacgccaaccgtcttcgtcgttcttcctaacgttccgttacccnctatccg

SEQ ID NO: 5847 - DNA, 845 bp, Homo sapiens
  misc_feature: GYAE6OF02I5DT9.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagngccaccctctcctgtgcggccagtcagacgcggttacggacgtaacttagcctggtatcagcgagacggcctggaccaggcctcccagacctcctctacgtttcgtttcggccgttaccgtttaacggacggggtcccaggttcggaaaccttccccgagcccgtacgggtttaccgacggccgggtaccgacggtttcgggggtacgtacgggggttaccctttttccgggtaccctaccgtttcccgttaaccgacccctaacgttaccctaaaaaccgtttaaccccgtaggttaccctaacgttacccggtttacggtaaacccgtttaaccgttttcggtaacccgttttaggtttttacctttaccggtttcgttaccggtacgtccgttaacgtttacgttaacgggtaaaccggttccggttaccgggttcccgttttaccggtttaccggtttacccggggtaaccggggggtaacgggtaaccggtttaacggggtaaccggtaacccttaaaccggaaacgttaccgttcgggttacgggtccgtaaccggtacccaacccgttacgttccgttaccgtttccgttaccgttacgtttacccccggtccccgttaccctacgtttacccgg

SEQ ID NO: 5848 - DNA, 605 bp, Homo sapiens
  misc_feature: GYAE6OF02I9E59.8.28.C06.1.454.CMB.1.raw
  modified_base (291)..(291): a, c, t, g, unknown or other
  misc_feature (291)..(291): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcggttaggacgaacttagcctggtatcagcagaggcctggccaggctcccagactcctnattctttggcgcctttaacgagggccaggtggaactcccacgccaggttcacggcggcaggtgggtctcggggacttcggttcacgtctccaccatccaaattaacctgcctaatcgtagacgtacttttgcttagttttacttctgtctagctgtctgaacgtctcggtccgttctaccgtttcgggacggacgggtaccaagggttccggaaaccttacgaaacggaccgttaggtggtaccgtacgaccgtaaccgtacttccgttcggttacctttacgtaccttccgtttaccccgactacttacccgg

SEQ ID NO: 5849 - DNA, 513 bp, Homo sapiens
  misc_feature: GYAE6OF02GFNQE.8.28.C06.1.454.CMB.1.raw
  modified_base (475)..(475): a, c, t, g, unknown or other
  misc_feature (475)..(475): n is a, c, g, or t
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcaggtgggtctgggacttcgtcactctcaccatcaataacctgacaatctgacgtactttgctagtttattctgtcagcagtctgaagactggccgttctacgtttcgggcggtagggaccagggtcgacctanaacgactgngctgcacntctgtcttcatcctccncntc

SEQ ID NO: 5850 - DNA, 585 bp, Homo sapiens
  misc_feature: GYAE6OF02GC4J8.8.28.C06.1.454.CMB.1.raw
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
  modified_base (378)..(378): a, c, t, g, unknown or other
  misc_feature (378)..(378): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggcagtcagagcgttaggacgtaacttagcctggtatcagcaggngcctggccaggctccagctctcatcttggcncctttaagagggccagtggaatcccgagccaggttcaggcgcaggtgggtctgggacttcgtcactctcacatacaataccnactactctagacgtacttgctagtttatttcgtgtcagtcagttactagagtacgtcggtacctttcgtaccggtttacggcgggtaacgggtaccgtaaggggtccgtaccgtaagaacccgtagtcggtcgaccgtacgtacctaccgtaatccgttacggttcctttaccgaacgtttcccgttccccgtactaccgttaccgg

SEQ ID NO: 5851 - DNA, 771 bp, Homo sapiens
  misc_feature: GYAE6OF02H86NI.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtctgtttttcctggggagagacgcccacccttctcctgtgccggccagtcagagtcgttaggacgaacttagcctggtatcagcaggacggcctggccaggcctcccagtacctcctctattccgtttagggccgttacctttaacgacggggtaccctaggtacggaaccttaccccgagtcccgtagggttccgacggccgggacgtacgggttcggggttccggtttacggggtaccttttaccgggtttacctaaccggttcctaccctaacccgtaacttaccaaaacgtttaaccccgttgaacccgtaacttccgttaaggtaacccgtaacttttcggtacgttacgtttttacgtttacgttcgttactacggttacctaacggttaccgttaaggtaaacgtaccggttacgggttccccgtttacgttacccgggtttccggggacgggtaaccggggaaccgtaacggggttaccgacccgttaacgaaaccgtacggtcggtacggtccgtcggacccaacgtactccgtttacgttcctttaccgtacttcccgtttccccgtactaacgttccg

SEQ ID NO: 5852 - DNA, 765 bp, Homo sapiens
  misc_feature: GYAE6OF02GL6HI.8.28.C06.1.454.CMB.1.raw
  modified_base (340)..(340): a, c, t, g, unknown or other
  misc_feature (340)..(340): n is a, c, g, or t
  modified_base (516)..(516): a, c, t, g, unknown or other
  misc_feature (516)..(516): n is a, c, g, or t
  modified_base (602)..(602): a, c, t, g, unknown or other
  misc_feature (602)..(602): n is a, c, g, or t
  modified_base (704)..(704): a, c, t, g, unknown or other
  misc_feature (704)..(704): n is a, c, g, or t
  modified_base (759)..(759): a, c, t, g, unknown or other
  misc_feature (759)..(759): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggtccctccgagagctactaggttggaagtaaggttgggtagtagtagaacccgaacgtacgttcccgttccggtaccctacccgttcgttcgtttttccgtttttccgggaggggacgacgtaccgacccctaccctcctcgtggtcggccgaccgtacgtacgagacggttacggttaacgaaccgttaacgtacgtccgtaggttacncgagacgaaggccgtccgtcggaccgacgtcccctaccggagttaccctcctaatcgtttcggtacgggaccctttaaccgtaacggggctaccgtaggttaccgaccctccgtacgtaccgtaggtcacgggcgtacggtcgggttacggtcggttacggttaccttccggtacnccgttaccacacgttaataaccgtaactaccgtgaactacgtcgtacgtacgtttcttcgtacgtttacgttttatccgtagtacncgtacttacgtcgtaacgtacgtcgtaccgttccgtaccgttcggttaccgggacggtacggtaaccggtagtccgtaaacctaacgtaacgtgtcgggtcncggtaacacctactacgttccttagtttccaccgtaccgtttcccacccgtactntaccgg

SEQ ID NO: 5853 - DNA, 682 bp, Homo sapiens
  misc_feature: GYAE6OF02GWGFI.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagagccaccctctcctgtgcggccagtcagagtcgttaggacgaacttagcctggtatcagcagaggcctggccaggcctccccagacctcctcatcgtttcggccgtcctttaacgagggtaccaggtcggaactcccgacgtccgtaggttcacggcggcgtaggttggggtcgtggggtacctttcggttccacttcctacaaccctactaccaaactaccctgacctaattcctacgtaccgttactttgacttaagttttactttcctagtacctagtcgtagttcctaggaacgtacgtcgggtcccgtttacgtaccggtttcgggacgggtaccggggtaaccggtaacgggtacggtaacccgtaacgtaaaccggtacgttggttacggccgttcggaccctaaccgtacgttccttccgttacctttacctaccgttccccgtttacccccgtaccttacgttcccgg

SEQ ID NO: 5854 - DNA, 660 bp, Homo sapiens
  misc_feature: GYAE6OF02FJ0NY.8.28.C06.1.454.CMB.1.raw
  modified_base (196)..(196): a, c, t, g, unknown or other
  misc_feature (196)..(196): n is a, c, g, or t
  modified_base (455)..(455): a, c, t, g, unknown or other
  misc_feature (455)..(455): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagacgcgttaggacgaacttgcctggtactcagcagaggcctggccaggcctcccagacctcctcattcgtttcggcgtccgttttaaacgacgggcctaggtggaactcccgagccgtagggttcagtcggctaggttgggtcgtgggtacgtttcgtacacgttcctactacctatacctaaacttaaccgtgtaactacttacgtgtaccgtacgtttcgtnttacgttttactttcttgtcgtacgtacgtagttctaggtaacgtaccgtcggtccgttacgttaccggtttcgggacgggtaacgggtaacgagggttcgaacccgtacgaaacgtacgttacggtcggtacgtacggaccgtacctacgtccggttacttccgtttaccgtaacgttcccgttccccgtacctacttacccgg

SEQ ID NO: 5855 - DNA, 838 bp, Homo sapiens
  misc_feature: GYAE6OF02I9FT2.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggaccagacggaaccatggaagccccagcgcagcttctcttcctcctgctactctggctccagagatcattggagaagtggtgatgacacagtctccggtcaccctgtcttgtttttccgnggggagagacgccacctctcctgtcgcggccagtcagacgtcgttaggacgtaacgttagccgtaggtactcgagctacggaggtcctggaccacgggccttacccgagtaccttccgtactactttccgtttcgggaccgttaccctttaaacggacggggtccctaagggtaccggaaaccttccccgaaacggtcccgtaacgggtttccgaacgggccggtaccgtagggttacgggggtaccgttacggggttacctttccggttctaaccgttccgtaccaacccgtagtaaccaaacgtttaacctcggtaaccgtaacttccgtacggtaaccgttaacgtttactacccgtttaaaggttttttacctttacccggtagttacccgtaagggttaccgttacggttaaccggttacgaaaacgggtttccggttaccggggtttacccgttttaaccgggtttaacccggttttcggggggaacccggggttaaacggggaacccgtaaagggttaccgggtaaacccttaacggtaaaccgtacgtttcgggaccggtttcgaacggtacctaacgttagtcctttgttacccttacgtaacccgttcccggtacccttccggtattacccgg

SEQ ID NO: 5856 - DNA, 593 bp, Homo sapiens
  misc_feature: GYAE6OF02F2NKW.8.28.C06.1.454.CMB.1.raw
  modified_base (113)..(113): a, c, t, g, unknown or other
  misc_feature (113)..(113): n is a, c, g, or t
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
tcagctcgcgtgtccacgaccggtgctcgatttagagctcacgtattgggtttgggggaggaactgctcagttaggacccagacggaaccatggaagccccagcgcagcttcncttcctcctgctactctggctcccagagatcattggagaagtggtgatgacacagtctccggtcaccctgtctgtttttccngggganagagccaccctctcctgtgccggcagtcagagcgttaggacgaacttaggccgtggtatcagcagaggcctggccaggcctcccagactcctcattcttggcgtcctttaacgngggccaggtcggaactcccgagcctaggttaccaggcggcgaggtgggtctgggtacttcgttcacgttctcaccatacaactaacctgactaatctagacgtactttgactagtttacttctgtctagtctagtctagataccgtggtccttcgtacgtttcgggacgggtacgggaccgaacgggtcgaccgtacgaaacgaccttgggtacgcgtcgacctaccgtcgttaccttcgttaccttctaccttcccgttcccgacctacgttaccgg

SEQ ID NO: 5857 - DNA, 718 bp, Homo sapiens
  misc_feature: GYAE6OF02JTIZS.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatcgactacagtctccggtcacccttgtccttgttttccgtggggagtgacgcccaccgtctcctgtcgccggctagtccagaggcggttaggaacgtaaccgtttagccgttaggtatcgacgcgaagtacgggcctcggtccgacggtcctacccgacggtacctcctactacgttccgtttcggccgttaccgtttaacgacgggtccgtaacgtcggtaactcccgacgtccgtaacggttcacggtcggtacgtacggtcgggtacgttcggggtacttttaccgtactacgtcctaccgtacctacttaacctaacgtaacctcgacctaacttccgaggtaccgttacgttttacgacgtttacttttaacgtttcctacgtacgtagttccgtagttgtagaacgttcgtaccgggtcctttacgtacgttccgggaggtacggaacgtagggccgtaacgtaaccgtaacgtcgttaggtccgtcggtcgtaccaccgtcgttcgtacggtttacccttagtaccgttcccgttaccgaccttgttaccg

SEQ ID NO: 5858 - DNA, 990 bp, Homo sapiens
  misc_feature: GYAE6OF02JBBXT.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaaggtggtgatgacacagtctccggtcaccctgtcttgttttccgngggganagacgccaccctctcctggtgcgccagtcagacggtcgtacggactaacttagccttggtactcacgcgaggacggccgtaggccgacgggccctaccccgagtacccttcccgtactacgttccgtttacggccgttacccgttttaaccggaacggggtcccaggttaacggaacctcccggaagtacccgtagggttcccgagggaccgggtccgtaagggttcgggggttaccgtttcgggggtaccctttttaccgggttaccctaaccgtttacccgtaccgtaaccctaacgttaaacccttaaaaacgttaccccgtacgtaaccgttaaactttacccgggtaaccgtttaaccgggttaccgttttaaccggttaacgtttttaaacgggtttttttaccgtttaccttaggggtttacccttaaacgggtaccgttaaacggtttaacccgtaaacggggttaaacccgggtttaacccggtttccgggtttacccccgggtttttaaaccggtttaaccccgggttttacccggggggtaaccggggggttaaaacccggggtaacccgggtttaaaacgggggttaaccccgggttaaaacccctttaaaccgggaaaaacccgggttaccggttacgggggtttaccgaccggggtttaacccgccccgttaaaccgttaacggttttcccgtttaacccggttttaccccgttaaccgtttaacccggttcccccgttttaccccggtaccctttacccggtttaacccggg

SEQ ID NO: 5859 - DNA, 563 bp, Homo sapiens
  misc_feature: GYAE6OF02H6PKU.8.28.C06.1.454.CMB.1.raw
  modified_base (315)..(315): a, c, t, g, unknown or other
  misc_feature (315)..(315): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagagccaccctctcctgtcgcggccagtcagagcgttaggacgaattacggcctggtatcagcagaggcctggccaggctcccagactcctcatctttggcgtcctttaacngggccagtggaatcccagccaggttcagcggcagtgggtcgtgggacttcgtcactctcaccatcaatacctgtcaatctgacgtactttgcttagtttattctgtctanctagtntcgtaagacgtcgtccgttctaccggtttcggacgggagggtaccgtaaggtcgtaccgtacgtaaacgtaccgtggtacggcgtgaccgacctacgtcttgtcttccacttcctcccctaccgtattaccg

SEQ ID NO: 5860 - DNA, 945 bp, Homo sapiens
  misc_feature: GYAE6OF02FKE9F.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccacctctcctgtgccggccagtccagacgtacggttaggaccgtaacttacgccttagggttactcgagcctaaggaggcccttgggccctagggcccttcccaggaccttccctactactttccgttttcgggccgtacccgtttttaaaccgacggggtcccaacgggttacggggtaaaaccttcccccgaaggtaccccgtacggggtttttacccgaacgggcccgggggtaccaaccgggggtttaggggggtttcccggttacgggggggttaacccgtttttcccgggttttaccccaaacccggttttcccgttaaccctaaaccccgtaacttacccgtaaaacctttaaacccccgtttaggtacccgtttaaaactttacccgttacgggtaaaccccgggtttaaacctttttaccggggttaccgtttaaacggtttttttaaacgttttcccgttacggtttacccggttaacgtaacggttaacgtttacccggttaacgggtaaacgttacccgtttaccgggggttccccgtttttaccggtaacccgggtttttacccgggggaccgggggtaacgggttaacccgggtaaaggggttacccggtaaccggtaaccgtaaaaccgggacgttacggtacgggtacgttacggacctaacccgtactttcccgttaacgtcgtttaccaccgtttcccttaccccgtaccttattacccgg

SEQ ID NO: 5861 - DNA, 795 bp, Homo sapiens
  misc_feature: GYAE6OF02JTWQE.8.28.C06.1.454.CMB.1.raw
  modified_base (208)..(209): a, c, t, g, unknown or other
  misc_feature (208)..(209): n is a, c, g, or t
tcagctcgcgtgtccacgaccggtgctcgatttagagctcacgtattgggtttgggggaggaactgctcagttaggacccagagggaaccatggaagccccagctcagcttctcttcctcctgctactctggctcccagtttcagataccaccggagaggtattgtgttgacacagtctccagccacctgtctttgctcgagggaacnncccacctctcctgcagggccagtcagaagtgttaggccgtacttcgaagcttacggtaccaacaaccaacgtcggacctacgcctaccgaacggcccccttagacttactacgtcggtacgactaccgtaccgaacgaccggggaccctacggttcggactaccgttacccgacggtaccccgtaggtaccgacggttacggacgtacggggttacggttaacgggacggggtaacctaacgggttacccgttacgtacccgtttaccccgttaaccgtaaacccgtactttaaccgaaacccgttaaccccggttactaacccgtaacgtttccggtaaccggttaaacccggtttacgtttacgtaaccgttttacgtttttaaccgtttccgttagtacttaccggtacgttacgttaccggaacggtacgttaccggttcgttacccgttacgttaccggttaccgggtacgggtaaccgttacgggtaaaggtcccgtaaccgtacggaaccgtacgtggtaccgtagtcccgtaactacggttctaccgttgtacccgtttacgtaccttcccgttaccg

SEQ ID NO: 5862 - DNA, 940 bp, Homo sapiens
  misc_feature: GYAE6OF02GM4TN.8.28.C06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgtaacttagcctggtatcagcagaggcctggccaggcctccccagacctcctctacttcgtttggccgtaccttttaaacgacggggtcctaaggttcggaaaccttccccgaaggcccgtaacgggtttccacgggccgggaccgtaagggttcgggggtaccgtttacggggggtaccttttccgggtttacctaaccgtttcccttaccgtaaacccctaacttacccgtaaaaccttaaaccccgtttaggaacccttaaacgtttccccgttaacgggttaaccccggtttaaccgttttttaccggtaacccgttttaaacgggtttttttaacctttttaccggttaccgggtttaccgtaaccgggtaccctttaacgggtttacccgttaaagggttaaacccggttacccggtttccggggtttacccccgggttttaccgtttaaaccccgggggtttttttcccggggggaacccggggggttaaaaccggggggttaaccccgggttaaaaccggggggtttacccgggtaaaccccgttaaaccgggtaaaaacccgggttaaccggttacgggttaccggggtaccgttaccgggacccttaaacccgtacgttaccggtttacgtttccctttacgttaacccgtttccccgtttacccccgtacccgttaccgtttacccgg

SEQ ID NO: 5863 - DNA, 195 bp, Homo sapiens
  misc_feature: GYAE6OF02HRTGG.8.28.C06.1.454.CMB.1.raw
  modified_base (179)..(195): a, c, t, g, unknown or other
  misc_feature (179)..(195): n is a, c, g, or t
tcagctcgcgtgtccacgaccggtgctcgatttagagctcacgtattgggtttgggggaggaactgctcagttaggacccgagacggaaccatggaagccccagcgcagcttctcttcctcctgctactctggctccagagatcattggagaagtggtgatgacacagtccgtcccgtnnnnnnnnnnnnnnnnn

SEQ ID NO: 5864 - DNA, 608 bp, Homo sapiens
  misc_feature: GYAE6OF02GISFF.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagacctcctcatctttggccgtcctttaacgaggccaggtcggaatcccagccaggttcagcggcaggtgggtcgtggggcttcggtcacgtctcaccatcaaatacctgactaatctagacgtactttgacttagtttactttctgtactagctagttctagtaacgtacgttcgggtccgtttccgtaccgttttcgggacgggtacgggtaaccgtaagggttccggaacctaaccgaaacgtaccgttaggtcggtacgtcggtaccgacctaacgttcgtacgttccttactaccgttcccgttccccgtcctacttccgg

SEQ ID NO: 5865 - DNA, 826 bp, Homo sapiens
  misc_feature: GYAE6OF02FLJOC.8.28.C06.1.454.CMB.1.raw
  modified_base (192)..(192): a, c, t, g, unknown or other
  misc_feature (192)..(192): n is a, c, g, or t
  modified_base (229)..(229): a, c, t, g, unknown or other
  misc_feature (229)..(229): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctccagagatcattggagaagtggtgatgacacagtctccggtcaccctgtctgttttccnggggagagagccaccctctcctgtgcggccagtcagngtcgttagacgtaacttagcctggtatcagcagacggcctggccaggcctcccgagtctccctacacttcgttacggtcctaccgttttaacgacggggcctaaggttacggaactccccgaagcccgtaagggttccgaggtcggacgtagggttcgggggttaccgtagggggttaacccttttccggtttacctaccgtttccgtacccaaaccgtacttaccgaaaaacttaacccgtcgtaaccgtaaacttaccgtacgggttaaacccgttaacgtttttcggaaccgtttaacgtttttttacgttacggtttcggttaaccgtaaggaccttacggtttaacggtacggtaaacggttaacccggtttcggggtaacccgttttaccgttaccgggtttccggggtaaccggggtaaaccggggtacccgttaaaaggggttacccggtaaaccccgttaaaccgggaaaaacgttacccgggttacggttcggaaccggttcgtaacccggtaacccgttatttcccggacgttttaccctttaccgttaaaccgttccccggtttaccccgaccggttacttacgg

SEQ ID NO: 5866 - DNA, 802 bp, Homo sapiens
  misc_feature: GYAE6OF02J3RR9.8.28.C06.1.454.CMB.1.raw
  modified_base (168)..(168): a, c, t, g, unknown or other
  misc_feature (168)..(168): n is a, c, g, or t
  modified_base (219)..(219): a, c, t, g, unknown or other
  misc_feature (219)..(219): n is a, c, g, or t
  modified_base (310)..(310): a, c, t, g, unknown or other
  misc_feature (310)..(310): n is a, c, g, or t
tcagctcgcgtgtccacgaccggtgctcgatttagagctcacgtattgggtttggggaggaactgctcagttaggacccagacggaaccatggaacgccccagcgcagtcttctcttcctctgcctactctggcctacccgagagatcagttggaagtaaggtggtanatcgaacactacgtccgtccggtcctaccgttgttcgtttcgttttccggngggaacgacgaccgtcccctaccttctccgtggtcggaccgtctaggtacgaaggtcgttaacgtacggtacctacgttcgccgtagtacncggagtcgacggcgtccgaggacccacgtccctacccgtgttaccctccttactcgttccggtcgtaccgttaaccgtacggcggtacctacgggtactaccctaccgacggtacgtaccggttacgcggtacgggtcgttacgggttccgggttaccgtacgttaccgtttcaaccgacctactacgaacctaacgttaaccgtaaactcgtaacctaccgtacgttcacgttaccgtttcgtacgttcttaacgttctacgttcgaaccgtcggtaactttccggtaacttaccggttaacgtcccgggtttaccgttaaccggtttccggtaacccgggttaaccggggtacggtaaacccgggttaaaccgttaaccgggtaaccgtaaacccttaaacgcccggttagtccgtacgtaccgtccgtaactcgttaaccttccggttaattccccgtacgtacccttaccgtccgtagtccgtaacgg

SEQ ID NO: 5867 - DNA, 786 bp, Homo sapiens
  misc_feature: GYAE6OF02IA6C9.8.28.C06.1.454.CMB.1.raw
  modified_base (202)..(202): a, c, t, g, unknown or other
  misc_feature (202)..(202): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtcgtccggtccacctgttctttcgtttttccggnggggagaggacgcccacctcctccgtggtcggcggacctagtcgaggacggtacggttaacggaaccgaacgttacggaccgttggtactacgagcgaggacgggcctagggccacgggccctacccgagacctccctactagttccgttttcgggccgtttaccgttttaaaccggacggggtacccgtaagggttaccgggaaccttcccggaacgtaccggtaacggtttacggacggccgggacgtaagggttcggggtcgggttaggggtaccgtttccgtttacctacgttcctacctaacctatacctaaacgtaacctacgactaacttcgtacgtaacgttcgtttactacgtttagtttacgtttacttgttaacgacgttcgtaagttcgtaagtaaacggtaccgttccgggttcttacgttccggtttacgggcgggtaacgggtacgtagggtaacggtaccgtaaacgtaacggacgtcggtacggtccgtaacggccctaaccgtaagtttcccgttgttacccgttacgttaaccctttcccgttaccccgtacctagttaacccgg

SEQ ID NO: 5868 - DNA, 631 bp, Homo sapiens
  misc_feature: GYAE6OF02FG2AO.8.28.C06.1.454.CMB.1.raw
  modified_base (195)..(195): a, c, t, g, unknown or other
  misc_feature (195)..(195): n is a, c, g, or t
  modified_base (315)..(315): a, c, t, g, unknown or other
  misc_feature (315)..(315): n is a, c, g, or t
  modified_base (324)..(324): a, c, t, g, unknown or other
  misc_feature (324)..(324): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagacgccaccctctcctgtgccggccagtcagagcgttaggacgtaaacttacgccttgggtaactcagcaaggaggcctggccaggcctcccgagactcctcatctttggccnctttaacgnggccagtggaactccagccaggttcagcggcacggtgggtctgggacttcggtcacgtctcaccatcaataacctgcaattcagacgactttcgctagttttatttctagtcagtacacgttctagaacgtacgtcggtccgttactacgttttcgggacgggtaacgggtaccgtaaggggtacggtaacccgttaccgaaaaccggtaacgttcgggtacggcgttaacgacccgtaaccgtagttaccgttaggttcccgtttacgtaacgtttccccgttcccggtacccctagttaacccgg

SEQ ID NO: 5869 - DNA, 766 bp, Homo sapiens
  misc_feature: GYAE6OF02GN787.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggcctcccagagatcattggagaagtggtgatgacacagtctccggtcaccctgtcttgttttccgngggganagacgccctaccctctccgtgtcgccggcagtcagagcgttaggacgtaacttagcctggtatcagcgagacggcctggccgacggtcctcccgagaccttccgtactacgttcgtttcgggccgtaccgttttaaacggacgggtccgaaggttacggaacctccccgacggccgtaagggtttaccgacggccggaccgtaggttcggggttccgttacgggtaccgtttccgttaccgtaccgttcctaccaacctacttaaccgtaaaccttaaccgtgtacctaacttccgtacgtaccgttacgtttacgtacttaagttttacttcgtacgttacgtacgtacgtagttacgaggtaacgtacgttccggtccgtttaccgtaccggtttaccgggacgggtaaccggtaaccggtaacgggttaccgtaaccgttaaaccgaaaccggttacgttacgggttacgtacggtaccgtacctaaccgtaccgttccgtttaccgttaccgtttaccgttaccgtttcccccgttacccggtaccgtaacgttaaccgg

SEQ ID NO: 5870 - DNA, 863 bp, Homo sapiens
  misc_feature: GYAE6OF02FV1KD.8.28.C06.1.454.CMB.1.raw
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
tcagctcgcgtgtccacgaccggtgctcgatttagagctcacgtattgggtttgggggaggaactgctcagttaggacccagacggaaccatggaagccccagcgcagattctcttcctcctgctactctggctccagagatcattggagaagtggtgatgacacagtctcggtcacctgtcttgttttccngggganagacgccaccctntcctgtgcggcagtcagagcgttaggacgtaacttagcctaggtactcgagacgaggtacggcccgtaggaccgacggtcctaccccgacgtaaccttcccgtacactttacgttttcggacccttaaccgttttaacggaccggggtaccctaagggttacgggtaaaccttaccccggaacggtccccgttaaggggtttaccgacgggtaccgggacgtacggggtttacgggggttccgttaacggggtacccttttaccgggtttaccctaaccgtttccggttaaccctaacccgttaactaaccgtaaaacgttaaacccgttcgggtaacctaacgttacccggttaacgtaaaccggttactttttacggaccttttaacggttttaacgtttccgttgtaaccgtaacggtccgtacgttacgtaacggaaacgttaccggtaccgggtttacccgtttacgtaccgggttttcgggaaccggggtaaccgggtaaccgttaacgggggtaaccgtaacccgttaaaccggtaaaccgttacggttccgggtacgtacccggtcgaacccgtactccgttaccgtttacgttaccgttacctaccgttttaccccgtacccggttaccgttacgttacccgg

SEQ ID NO: 5871 - DNA, 765 bp, Homo sapiens
  misc_feature: GYAE6OF02IWE1P.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgtttttccgnggggagagagcccacccgtctccgtgtgcggccagtcagagtcgttaggacgtaacttagcctggtatcagcagaggcctggaccaggcctacccgagtacctcctctagttccgtttggccgttaccgtttaacgacggggtaccctaagggtcggaaaccttccccgaaggttccgtacgggttccgaaggccgggacgtaggttcggggtaccgttacgggggtacctttccggtttaccgaacctttcctacctaacctaacgttaccctaaaagttaacccgtttggaccgttaaacgttccgtacggtaacccgtaagttttcgaaccgtttagtttttaacttccgttacgttacgtacggtacgtacgttcgtaaggaaccgtacgtcgggtaccgtttcgtacggtttacgggaccgggtacgggtaaccgaacggggttaccgacccgttaacgtaaaccggtaacgttcgggtacggtacggtccgtaccgtaacctaggttaccgttacgtttaccgttaccttaccgtttcccgtaccccggtacctacgttaccg

SEQ ID NO: 5872 - DNA, 688 bp, Homo sapiens
  misc_feature: GYAE6OF02I6NEX.8.28.C06.1.454.CMB.1.raw
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (269)..(269): a, c, t, g, unknown or other
  misc_feature (269)..(269): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctcccagagatcattggagaagtggtgatgacacagtctccggtcaccctgtcttgtttttccgnggggganagacgcccaccctctcctggtcgccggccagtcagagtcggttaggacaacttagctggtacncagcaggacggcctcggaccaggcctacccgagtcctcctctactttcgtttcgggaccgttaccgtttaacgacggggtcctaggtaccccggtaatccccgaggtacccgtaggttaccgaagggccgggtacgtagggttcggggtccgtacggggtacctttcggttacctactccgttccaacgtacttaaccaaacgttacccgtgactaacgttcgtacgtaacgttactttcgtacttagtttactttcgtcgtacgtagtacgtagtctagtacgtcgtcggtaccgttacgtacggtttcgggacgggtacgggacgtacgggtacgtaacctacgtaaacgtagttacggcggtacgtcgactaccgtactcgtcgttactctccttaccgtcccgtacctacgtacg

SEQ ID NO: 5873 - DNA, 694 bp, Homo sapiens
  misc_feature: GYAE6OF02GY3LG.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (266)..(266): a, c, t, g, unknown or other
  misc_feature (266)..(266): n is a, c, g, or t
  modified_base (657)..(657): a, c, t, g, unknown or other
  misc_feature (657)..(657): n is a, c, g, or t
tcagctcgcgtgtccacgaccggtgctcgatttagagctcacgtattgggtttgggggaggaactgctcagttaggacccagacggaaccatggaagcccagcgcagcttctcttcctcctgctactctggctacccagagatcattggagaagtggtgatgactacagtctccggtcaccctgtcttgttttccngggganagtagcctacctctcctgtgcggccagtcagngcggttaaggactaactgcctggatcagcagngcctggccaggctcccgacgactcctactacttctttcggacccgtacctttaaccgacggggtcctagggtacgtacgaccctaggccgttacgggttcaacgggccggtgtacgggtcgggtcggtagggtacctttccggtttacaccgttccactaaccctacgttaaccaaaccgttaacctggtaaccgtaacttcgtacgaaccgttaacgtttacggttacttaagtttacgtttcgttacgtacgtacgtactacgttacgttacgtaagaacgttcgggtaccgtttacggtaccgttttaccggggacggtaacgggtaccggtaacggtacgggtaccttacggaaacgtacgtacgtcggtcgtacgtacgccttacncgtttcgtacttacgtacttcctacccgcgtactacg

SEQ ID NO: 5874 - DNA, 717 bp, Homo sapiens
  misc_feature: GYAE6OF02GBYP0.8.28.C06.1.454.CMB.1.raw
  modified_base (316)..(316): a, c, t, g, unknown or other
  misc_feature (316)..(316): n is a, c, g, or t
tcagctcgcgtgtccacgaccggtgctcgatttagagctcacgtattgggttggggaggaactgctcagttaggacccagacggaaccatggaagccccaagcgcagcttctcttcctcctgctactctggctcccagagatcattggagaagtggtgatgacacagtctccggtcacctgtctgtttttcctggggagagagccaccctctccgtgtgcggtccagtcagacgcgttagacgaacttagcctggtatcagcagtaggcctggccaggctcccagactcctctatcgtttggcgtcctttaaacgngggtcccaggtcggaactcccagaccgaggttcagcggtcaggttcgggtctggggtacttcggtttcacgttctcgaccctagtacctaaactaaccctgacctaaattcctagaaccgtactttcggaccttagtttaatttcgtcgtactacgtacgtagttacctagtaaacggtacgttcgggtcccgtttcgttaacccgttttcggggaccggggtaacggggtacccgtaaaacggggttcgggtaaacccctaacggtaaaacccggtaaaccgttcgggttacgggtccgttaacgggtaccctaacccgttaaccgttccgtttacggtttacctttcccggttaaacctttccccgtttttaacccccggaccttaaccgtttcccggg

SEQ ID NO: 5875 - DNA, 799 bp, Homo sapiens
  misc_feature: GYAE6OF02IFYGU.8.28.C06.1.454.CMB.1.raw
  modified_base (168)..(168): a, c, t, g, unknown or other
  misc_feature (168)..(168): n is a, c, g, or t
  modified_base (198)..(198): a, c, t, g, unknown or other
  misc_feature (198)..(198): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctcccagagatcattggagaagtggtgatgacanagtctccggtcaccctgtcttgttttccgnggggagagacgccacctctccgtgtcgcggcagtcagagcgttaggacgtacttagctaggtactcagcgagacggtcctggaccaggcctcccgaagacctccgtacacgttcgttacggccgttacctttaaacggacgggtaccctaggtaccggtaaaccgttccccgaaagggtcccgttagggttaccgaacgggccgggtactaacggggttcggggttccggtacggggttaacctttccggttacctaaccggttcctacccaaccgttaaacttaccgtaaaccttaaccgtcgtaaccttaaacgtccgtacgggtacgttaaccgtttggtaccgtttaagttttaacgtttccgtaggtactacggtacgttagttacgttacggaaacgtcgttaccgggttacgttaccgtaccggtttacgggaccgggtacgggtaaccgtaagggttcccggtaaaccgtaccggtaaaccggttacggtacggtacgggtccgtaaccggtacccgtaacggtaccttacggttaccgttcccgttacttaccccgtttacccggtttacccctacgtaacgtttacccggg

SEQ ID NO: 5876 - DNA, 750 bp, Homo sapiens
  misc_feature: GYAE6OF02FS9IM.8.28.C06.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (281)..(281): a, c, t, g, unknown or other
  misc_feature (281)..(281): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagtttcagataccaccggagagattgtgttgacacagtctccagccaccctgtcttgtctccgagggaangccaccctntcctgcgaggccagtcagaatgttgcgcttcgancgtgtacacacaactgcagctccacgccctnactctagtggtgcactaccaacgacgggtcccacgtcggacctactccccgagacccgtaggttccgaggttcggacgtagggttaggggttagacgggacgtaggttaccgtacgacccttcgttaaccctacccgtactacctacgtaccgaccggtccgtacgggtaaccgccgttaggaacgtagttcggttacgacgtttaaggttttactttaccgttagttacccaaacgttcgttacccggttacggtacgggtccgttacccccgggggtcggggtaacccccgtttaccgggtttcccggggtaccccgtacgggggtaaaacccgttacggggttacgggttaaacccttaaggttaccccggtaaaacggttccgtaacggggttcccgtaaccgttaccggaacccgtaccttaaccgggtttccctttcgggttaccctttaccggttacccccg

SEQ ID NO: 5877 - DNA, 761 bp, Homo sapiens
  misc_feature: GYAE6OF02GIUKK.8.28.C06.1.454.CMB.1.raw
  modified_base (205)..(205): a, c, t, g, unknown or other
  misc_feature (205)..(205): n is a, c, g, or t
tcagctcgcgtgtccacgaccggtgctcgatttagagctcacgtattgggtttgggggaggaactgctcagttaggacccagacggaaccatggaagccccagcgcgagcttctcgttcctcctgctactctggctccagagatcattggagaagtggtgatgacacagtcgtccggtcaccctgtcttgtttttccgtgggganagacgccacctctcctgtcgcggccagtcagagcgttaggacgtaacttagacctggtatcagcaggacggccgtggccaggcctacccgaggacctcctacagttcgtttcggccgtacctttaacgacggtccgtaggtcggaactcccgagccgtaggttcgaacggcggcgtaacggttcgggtaccgtacgggttaccttaccggttacctaccgttacctacctaaccctacgtaacctaaacgttaacccgtgaacctaacgtaccgtagaaccgttacgtttcgaacgtttacggttttactttacgtacggtacagtaccgacggttacgtaacggtaacgtaccgttacgggtacccggtttaccgttaccggttttaccggggaccgggtaacgggtaaccgttaaccgggtaccgggtaaccctaaaccggaaaccgtaacgttcggtaccggtccgtaacgtaacccgtacccgtaacggttccgttacgttacccgtttaccgttaccgtttaccccggttacccgaccgttacgttaccgg

SEQ ID NO: 5878 - DNA, 936 bp, Homo sapiens
  misc_feature: GYAE6OF02HIHYL.8.28.C06.1.454.CMB.1.raw
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgcgtcagttaggacccagacggaaccatggaagccccagcgcagcttctcttcctcctgctactctggctcccagagatcgattggagaagtggtgatgacacagtcctccggtcacccgtgtcctgtttttccngggtagagacgccaccctctccgtgtcgcggccagtccagacgcgttaagacgaacgttacgcctggtatcgagcagaggcctggccacggcctcccagacctcccgtactagttcctttggaccgtacccttttaacgacggggtaccctaggtacgggtaaccttccccgaaggtccccgtaaggggtttcccgaaacggtccgggacctaaacgggtttcggggggttcccttaggggggtaaccttttcccggttttaccgtaacccgttcccttacccgtaacccctaacttaacccgtaaaaccgttaaccccgtttcgaaacccgtaaacttccgtacgggtaaccccgttaacccgttttttcgggaaccctttaacgttttttaaccgttttacccgttacggttacccgtaaggttacccgttacgggtttacccggttaaccggtaaaaccgggttacccggttaccggggtttaaccccgttttaaccccgttaccgggtttttaccccggggggaccggggtaaacccggggttaacccgggttaaacggggttacccgggtaaaacccgtttaaccgaaaacccgggtaaccgtttacgggtaccggtaccggttaccggaacccgttaaccccggtaaggtttaccccgttagggtttaccctttaccggttaacccgtttacccccggtttacccccgacccgtttaccgttaccccggg

SEQ ID NO: 5879 - DNA, 705 bp, Homo sapiens
  misc_feature: GYAE6OF02GUBLO.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccacctctcctgtgcggccagtcagagcgttaggacgtaacttagcctggtatcagcaggaggcctggccaggcctccccaggacctcctctattcgtttggccgtaccgtttaacgacggggaccaggtcggaactccccagccgtaggttcaggcggcaggttggggtcgtggggtacctttcggttacactcctacaaccctataccaaacttaaccccgtgtacctaaacttccgtacggtaaccgttaccgttttcggaccgtttaagtttttacgttttccgttcgttaccgtacgtactagttacgttaaggaacggtacgttccgggttacccgttaccgttaccggttttccggggaccgggtacgggtaaccgaagggttccggaaccctaacgaaaccggtaacgttggtacggtccgtcgaccgaccgttacttccgttacggttcctttacgtaccgtttccccgtttaccccgtcctacgttaccg

SEQ ID NO: 5880 - DNA, 633 bp, Homo sapiens
  misc_feature: GYAE6OF02FL2Z6.8.28.C06.1.454.CMB.1.raw
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
  modified_base (428)..(428): a, c, t, g, unknown or other
  misc_feature (428)..(428): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagagccaccctctcctgtgcggccagtcagngcgttaggacgaacttagcctggtatcagcagaggcctaggccaggctcccagactcctacatcttggcgcctttaacgaggccagtaggaactcccagccaggttcagcggcaggtgggtctgggacttcgttcgacttcgtcaaccgatcaaatacctgacaatctacgtacgactttcgactagttttactttntacgttacagtctagtctagaacgtactcgggtcccgttactacgttttccgggacgggtaacggggtacctaaacggggttcggtaaacccgtaccgtaaaacggaaccgttggtacgggccgtaggaccctaacccgtaagttccctttagggttcccttttacgtacctttacccgtttccccgtacccggtacttacccgg

SEQ ID NO: 5881 - DNA, 717 bp, Homo sapiens
  misc_feature: GYAE6OF02H2DPH.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcacctgtcttgttttccgnggggangacgcccacctctcgtgtcgcgccagtcagagcgttaggactaacttacgctggtactcgagcaggacggccgtggaccacggtcctccccgagacccttccctatacttccgttttcggaccgttacctttaaaggcgggacctaggtacggtaacctcccgaggtcgtacggttcgacgggcggtcgtaggttcgggttaccgtggggtaacttttccgggtacctacgttcctccaacgtactaccgtaaaactacgtcgactaatcgtacgtacgttactttcgtacgtttacgtttacttactcggtacgtacgtacgtacgttaactacggtaacgtaccgtcgggttaccgttaccgtttacggtttaccggggacgggtaaccgggtaaccgtaacggggttccgtaaaccgtaacgaaaccgtgttacgggtaccggtacgtccggaacctacgtaacgttactacggttccttaccgtacctttccccgtacccgtgttacctacgg

SEQ ID NO: 5882 - DNA, 863 bp, Homo sapiens
  misc_feature: GYAE6OF02IHBSB.8.28.C06.1.454.CMB.1.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagacgccacctctccgtgtgcggccagtcagagcgttaggacaacttagcctggtatcagcaggacggcctgggccaggcctcccgacgacctccctactacgttccgttttcgggccgttaccgttttaaacgacggggtcccgtaaggtacgggtaactaccccgtaacggaccgtaacgggtttacccgaaggtccgggtacgtacgggttcgggggttaccgttacggggggttaacccgttttcccggtttacctaaccgttcccgttaccctaacccgtaaacgtttaccctaaaaacctttaaacccgtttccggaaccttaaacgttaccgggttaaccgtaaacccggtttaaaccgtttttacggtaccgtttttaaaacgggtttttacttttaccgttacggttaccgtaacggttaccgttacggttaacgtacgggttaaaccggtaccggttaccgggttcccgtttaccggttaaccgggttttcggggtaccggggtaacgggtaaccgggttaaacggggttaccggtaaccttaaaccgtaaacggttaacgtcgggttacgggtacccgtaggtaccctaacgtaaccttcgttacggttccgttcttaccgttacccggttcccgtaccgttacttaccgg

SEQ ID NO: 5883 - DNA, 711 bp, Homo sapiens
  misc_feature: GYAE6OF02JBFBV.8.28.C06.1.454.CMB.1.raw
  modified_base (97)..(97): a, c, t, g, unknown or other
  misc_feature (97)..(97): n is a, c, g, or t
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaanccccagcgcagcttctcttcctcctgctactctggctcccagagatcattggagaagtggtgatgacacagtctccggtcaccctgtcttgtttttccgnggggagagacgcccaccctctcctgtcggcggccagtcagacgcggttaggaacgtaacttggcctggtactcgagacaggacggcctgggccaggcctcccagtacctcctctacttccgtttcgggccgtacctttaaccggacggggtacctagggtacggtaaaccgttccccgaacgtacccgtagggttaccgacgggtccgggacgtacggttcgggggttacgtacggggttacctttccggtttacacgttcctaccacctactactaactacctgactatctacggtacttacttcgtacttagttttactttactgttacgacgtctacgttcgtagtaacgtccggtcggtacccgttcgttaccggtttcggacggggtaccgggtaacgtaacgggtcgtaaaccctaacgaaccgtacgtcgtacggtcgtacgacctaacttacttcgttacgttacctttacggtaccctttcccggtaccctaccgtacgttaccg

SEQ ID NO: 5884 - DNA, 741 bp, Homo sapiens
  misc_feature: GYAE6OF02GX5BT.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagtagagcccaccctctccgtgtcgcggccagtcagagcgttagacgaacttagcctggtatcgagcagacggctcggccacggcctacccagacctcctacgtattcgtttggccgtacctttaaacgacggggacctaggtacggtaaccttccccgacggaccctagggttaccaacgggcgacgtaggttcggtacggttggggtaccttttcgggtacctacctccgtaccaaccgtataacctaaactacctcgtaactaacttcgtaccggtaacgttaccgtttacggtacttaagttttacgtttcgttacgttactaacgtcgtacgttaccgtagtaaacgttccgtacgggtacccgtttaccgttaaccggtttccggggacggggtaaccgggtaaaccgggtaacggggttacccgaaccgtaaaccgtaaacgtaacggttcggtcgggtaccgtcgacctaccgtacttaccgttacgttaccgttccttaaccgttcccgtaccccgtccgttacttaccgg

SEQ ID NO: 5885 - DNA, 742 bp, Homo sapiens
  misc_feature: GYAE6OF02HBBI6.8.28.C06.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctcccagagatcattggagaagtggtgatgacacagtctccggtcaccctgtcttgttttccgngggganagcgcccacctctcgtgtcgcgcctagtcgagacgtcgttaaggaccgtaacttcgccgttaggtactacgagacgaggtacggcctcggaccgagtccctcccgaacgacccttacctctaacgtttccgttcggccgttacctttaaacggacgggtccagggttaccggaacctcccgacggtaccgtaacggttacaacgggtccggtacgtaaggttcggggttaccgtcgggttaccctttcgggtccctacgttacctaccaacccgtaacttaacaaccgttaacccgtgaacctaactccgtacgaaccgttacttaggacctttaagtttctttcgtagtacacgtcgtaacgttcgtagtaacgtacgtcggtaccgttacgttcccggttaacgggaccgggtacggtaaccgtacggtacggtaaacccgtagtaaaccgtacgttcgggacgtacggtaaccgtacaaccgttaattccgtaccgtttcgttaacctccgttcccgttcccctacgtcgtacgg

SEQ ID NO: 5886 - DNA, 703 bp, Homo sapiens
  misc_feature: GYAE6OF02H1QSI.8.28.C06.1.454.CMB.1.raw
  modified_base (318)..(318): a, c, t, g, unknown or other
  misc_feature (318)..(318): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctctcagtttcagataccaccggagagattgtgttgacacaatctccagccaccctgtccttcgtctccgaggggaagagccacctctcctgcacgggccagtcagaatggttggcgctacgtatcctggtaaccaacacgaaacctggccacggcctacccgacggcccctcacgtctacgtggntcgtatccgaacgacgggccaacgtggacactccacgccgaggttcaggttcgggtcgggtagggtaggtcggggactacggaacttacgtaccctactactacccactacacttacgacgtcccgtagggaccgtccgtaggaaggtacgttacggttcggtacgttaaggtttactttacgttagtacctaaactacgtaccgttacggttacggtaccgggttcccgggtccggggacccgttaccggtttcccggtcccggtacgggtaaccgtaagggttacggtaccgttaacgtaccggtaaaacggtaccgttacggtacggtacgtccggtaacctacccgtaagttcccgtttacgtcccggtttacttaccccg

SEQ ID NO: 5887 - DNA, 786 bp, Homo sapiens
  misc_feature: GYAE6OF02IT6B2.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggcctcccagagatcagttggaagagtggtgatgacacagtcctccggtcacctgtcttgttttccgnggggagagcgccacctcgtcctggtcgcggacctagtcgagaggtacggttaaggaaccgtaacttcgccgtaggtactacgaacgtcgaggacggccgtcggccgacggtccctaccgacgtaccgtcctactacgtttcgtttacggacccgttacctttaaccggacggtacgtaacggttacggtaaccgtccccgaacggtcccgttaaggttcgacggcggtacggtacgggttcgggtacggttacggggttacctttccggtttaaccgtccgttccgtaaccgaacttaacgttaacctaaaccggttacctaacgacctaacgttccgtaaggtaaccgttacgtttactacggtttactttaacgttacgtcgtactacgtacgtacgttacgtaagtaaccgttcggtaccggtacgttaccgttaacggttcgggaacgggtaacgggtaaccgagggttaaccgtaccgttaaaccgaaacgttcggtacgtaccggtacgcggtaacccaacgttacgttaccgttacgttaccgttaccgtaccgtttacccgttcccgtactaccgttacgg

SEQ ID NO: 5888 - DNA, 631 bp, Homo sapiens
  misc_feature: GYAE6OF02I8KXV.8.28.C06.1.454.CMB.1.raw
  modified_base (509)..(509): a, c, t, g, unknown or other
  misc_feature (509)..(509): n is a, c, g, or t
  modified_base (530)..(530): a, c, t, g, unknown or other
  misc_feature (530)..(530): n is a, c, g, or t
  modified_base (576)..(576): a, c, t, g, unknown or other
  misc_feature (576)..(576): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaaggtggtgatgacacagtctccggtcaccctgttcttcgtttttccgtggggagtagacgcccaccctctcctgcgagggccagtcagtaattcggttcggccgtccttacggtaagtccgtacggtaacccaaactaaccaaaccgtcggaccgacggccctacccgaaccggcccctacgtacttccgtagtggtcgacctacgtacccaacgacgggccctacgcggactacctcccgacgaccgtaggttacgagggtccggcgtaagggtcgggtagtcggggtaactacggtacttacacctctaccgaaccattaccactcgacgccttagggactcgtagactgtcgtnacgttattatctagacacgtntcgagtcgtcggccgtaccggcttcggtcgcgacggacaggcgtanacgttaacgaacgtgtcgtgacctgactacgtatccgtatacccttgaccctccg

SEQ ID NO: 5889 - DNA, 757 bp, Homo sapiens
  misc_feature: GYAE6OF02HT0P1.8.28.C06.1.454.CMB.1.raw
  modified_base (192)..(192): a, c, t, g, unknown or other
  misc_feature (192)..(192): n is a, c, g, or t
tcagctcgcgtgtccacgaccggtgctcgatttagagctcacgtattgggtttgggggaggaactgctcgagttaggacccagacggaaccatggaagcccagcgcagcttctcttctcctgctactctggctccagagatcattggagaagtggtgatgacacagtctccggtcacctgtcttgttttccnggggagagagccacctctctgtgcgcagtcagagcgttaacggacgtaacgttagccgttggtactcgagcgaggtacgcctggccaggcctccagaccttccgtcaacttccgtttcggaccgtacccgtttaaggcgggtccctaaggttcggaacctccccgagtcccgtaaggttccaggcggtcgtaaggttggggtacctagggggtacctttcggttaccaccgttccgtacctaaccgtacgtacctaaacttaaccgtcgtaactaaacgttcctacggtaaccgttacgtttacgtacgtttaagtttttactttaccgttagttacacggttacgttacgttacgttaacggtaaacgttaccggtaccggttaccgttaccggttaccggtttacggggaccgggtaaacgggtaccgtaacgggttacccgtaacctaaccggtaaaaccgttcggttacgggttcgtaccgtacgaccgttaaccgtacgtttcccgttacggttccctttaccgacccgtttacccggttccccgtacgttacctaccgg

SEQ ID NO: 5890 - DNA, 861 bp, Homo sapiens
  misc_feature: GYAE6OF02ICX1R.8.28.C06.1.454.CMB.1.raw
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgactactcgtggcctccagaagactcattggaagtaaggtggtgatgaacacgtacgtctccggtacacccgttgtctttggtttttccgngggganacgtacnccacctctcgtgtcgcgcctagtccagtacgtacggttaacgaacgtaacttcgaccgttaggtactacgagtacgtaacggacgggtccgtacggggacccgaaacggtcccctaacccgggtaaccgtaacccttccccgttaacgtttactttacccgggtttttacgggtaaccccgtttaaccggttttaaaaccgccggggggttaacctaaacggggttccggtaaaacccttcccggaaacgggttaaccggttacggtttaccgacgggtccgggtaacggttaggggtccgggttaacggtttacgggtaacctttaccggtttaccgtactaccgttaccgaaactaagtacctaaaacgttacctacgaactaacgtcgtaacgacgttacgttcgtacttagtttacttacgcgttacgacgttaccgtagttacggtaacgtaacgtgtttaccggtaccgttaccgtttaacgggtaccgggaacgggtaccggtaaacggtacgggtaaccggtaaccgtaaacgtaaactcggttacggtaccggaacgtccgtaaaccgtactaccgttcgttacggttacttacggtacccgttccctacccggtactagttaccg

SEQ ID NO: 5891 - DNA, 666 bp, Homo sapiens
  misc_feature: GYAE6OF02HXTNH.8.28.C06.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (388)..(388): a, c, t, g, unknown or other
  misc_feature (388)..(388): n is a, c, g, or t
  modified_base (422)..(422): a, c, t, g, unknown or other
  misc_feature (422)..(422): n is a, c, g, or t
tcagctcgcgtgtccacgaccggtgctcgatttagagctcacgtattgggtttgggggaggaactgctcagttaggacccagagggaaccatggaagccccagctcagcttctcttcctcctgctactctggctccagataccaccggagagattgtgttgacacagtctccagcccaccctgtctttgtctccaaggggaaancgcccaccctctcctgcagggcagtcagagtgttacccaccagttagcctaggtaaccaacacaaacctggccaggcctcccaggccccctnactctttgatgacactcatcgagggcccatcggcactccagcctagggttcaggtggcgtaggtcggtacgtgggaactgtacttcacttcncacatcgagcacgtacctagacgcctagaagttntttgactagttttacttactacggtactaacgtacttcggttaaccgaggttaccgggcccgttacccgggggtaccttaccgttttacccggggacccttacggggaaaaccttaaaaggttcggaaacgtaactaaccgtaaacggtaccgttaggtacgggtaccttacggacctaaacccgtacgtttaccggttacgttaaccgtttcctaaccggttttcccccgtacccccgtaacg

SEQ ID NO: 5892 - DNA, 656 bp, Homo sapiens
  misc_feature: GYAE6OF02JYO8E.8.28.C06.1.454.CMB.1.raw
  modified_base (232)..(232): a, c, t, g, unknown or other
  misc_feature (232)..(232): n is a, c, g, or t
  modified_base (563)..(563): a, c, t, g, unknown or other
  misc_feature (563)..(563): n is a, c, g, or t
  modified_base (587)..(587): a, c, t, g, unknown or other
  misc_feature (587)..(587): n is a, c, g, or t
  modified_base (615)..(615): a, c, t, g, unknown or other
  misc_feature (615)..(615): n is a, c, g, or t
tcagctcgcgtgtccacgaccggtgctcgatttagagctcacgtattgggtttgggggtaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcgccagtcagncgttagacgaacttagcctggtatcgagcaggacgccgtggccaggtcctacccgagtaccctccgtctacttcgtttcgggacctcctttaacggacgggcctagggtcggaaacgttccccgaggaccctagggttaccgaaggtccgggtacaggttcggggacttcggggacctttcggtacctacgtcgttaccaccattacaacgttacctggacctatcacggacttaacgttcgtacttagttttacttgtactcaggtaccctagtctagaacgtccttgggacctcgttacgtcggaagggacggttaacgaacgggttanaccgtaactaaacgtcctgggtancgtaaccggcctaaccagttccggtttntaaccctttcgacctttccccggtacccggtctacccgttc

SEQ ID NO: 5893 - DNA, 617 bp, Homo sapiens
  misc_feature: GYAE6OF02JCZFQ.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (255)..(255): a, c, t, g, unknown or other
  misc_feature (255)..(255): n is a, c, g, or t
  modified_base (445)..(445): a, c, t, g, unknown or other
  misc_feature (445)..(445): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccgnggggangagccacctctcctgtgcggccngtcagcgcgttagactaacttgcctaggtancagtccagacggctcggccaggctcccagacctcctcattcttggccgtacctttaacgacgggtccaggtcggaactcccgagccgtaggttcgagtcgacgaggtgggtcgtgggtactttcgttcacgttcctcactatactaactactgactacgtctacgacgtactttgaccttagtttacttntcgtctagctacgttctagtacgtatcggtccttactacgtttacgggacggtaacgggtaccgacgggtacgtaacccgtaagaaaccgtaacgttggtcggtccgtcggtaccaaccgtgttacgtcgttaccgttctacccgttacccttcccggactaccgttaccgg

SEQ ID NO: 5894 - DNA, 756 bp, Homo sapiens
  misc_feature: GYAE6OF02GKCQG.8.28.C06.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (344)..(344): a, c, t, g, unknown or other
  misc_feature (344)..(344): n is a, c, g, or t
  modified_base (396)..(396): a, c, t, g, unknown or other
  misc_feature (396)..(396): n is a, c, g, or t
tcagctcgcgtgtccacgaccggtgctcgatttagagctcacgtattgggtttgggggaggaactgctcagttaggacccagacggaaccatggaagcccagcgcagcttctcttcctcctgctactctggctcccagagatcattgtagaagtggtgatgacacagtctccggtcacccgtgtcttgtctcgaaggggaaancgcctacctntcctgcacgggcagtcagtatgtgcnccttgagntcgaacaacacaacnggccaggctaccgagcccctnatctatggtnctactaccaacgacggcccaagtcggacctactacccgagccgtacggttnacggtggactacggttagggggtatcggggaactagacccgtttcaaccgtnttacccaacccgttataccgtaactccgtaacggtcccgttaaggggaccgtaccggtaacgggtaacgtaacggtttcggttaacgccggtttaaagtttttacgttaacttcggttaaaccctaaaaccgttcggtaaccggttaaccggtagggtttcccgggcccgggtttaccccgggggaccctttaacccggttttcccggtaccccggggtaacgggttaacccggtaaggggttcgggaaccgtaaccgttaaccgaaaccgggttaaccggttcggttaccgggtcgtaacgtacccgaaccgttcgttttaccgacggtttttacccgttacgtcccgtttaaccccgg

SEQ ID NO: 5895 - DNA, 770 bp, Homo sapiens
  misc_feature: GYAE6OF02GW2KG.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgtggggagagacgccaccctctcctgtgcgccagtcagagcgttaggacgtaacttagccttggtatcagcaggaggcctcggccaggcctcccgagaccttcctctacttcgtttacggccgtaccttttaaccgacggggtcctaaggttacgggaaccttccccggaacgtacccgtacggtttaccgaacggtccgggacggtaggttcgggggttaccgttagggggtaaccttttcgggttacccttacgttccgtacctaaccctattacccgtaaaacttaacccgtcgacctaaacgttcgtacggaaccttaccgttttgtacgttacgtttttactttccgttagtaccgtaaggtcccgttaagtttccgtaaggtaacgtccggttccgggttaccgtttaccggttaccgtttaccggggccgggtaacgggtaacccgtaacgggttaccggaacccgttaacgaaccgttaacgtcggtacggcgtaacgacccgtaccgtaacttccgttacgttccgttaccgttaccgttcccgttcccggtacctacgttacccgg

SEQ ID NO: 5896 - DNA, 880 bp, Homo sapiens
  misc_feature: GYAE6OF02GQMMZ.8.28.C06.1.454.CMB.1.raw
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
tcagctcgcgtgtccacgaccggtgctcgatttagagctcacgtattgggtttgggggaggaactgctcagttaggacccaggacgggaaccatggaagccccagcgcagcttctcttcctcctgctactctcggctccagagatcaagttggagtaagtggtgatgacacagtctccggtcaccctgtcttgttttcgngggganagacgccaccctctccgtgtcggcgaccagtcagacgtacgttacggaacgtaacttacgaccgttgggtactcgtaacgcgaggtacggccgtacggacccaagggtcccctacccgacggtacctacctacttacgttcggtttacggggcccgttaaccgtttaaccggaggtacccgtaggttacggaaacttcccgacgtcccgtaggttccgaggccggtacgtacgggttccggggttacgttacgggttcccgtttcggtttacgaaccgtttcctaaccaaccttactaccttaaaaccgttaaaccctcggtaaacctaacgttacccgttaacgttaacccggttactttttaccgggtaattttaaacggtttttttaaccgtttacgttaaacccggttacgaacgggttaacgtaaccgtttaccggtttaaagaaccgggttaaaccggttccgggtttaccgtttaccggttaaaccgggttttcggggggaaccgggttaaacgggttaaccgggttaaaccggggttcccgtaacccgtaaaacggtaacccgttacggttacggtaccggttaggtccggaaccctacgttaccgttccgttaacggttccctttacggttacccttacccgttccgaaccgtttcgttaaccgg

SEQ ID NO: 5897 - DNA, 738 bp, Homo sapiens
  misc_feature: GYAE6OF02ICO4N.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctggtcgccggccagtccagtaggtcgttaaggaccgtaacttagccgttggtactcgagctaggacggcctggccaaggcctacccagacctccgtcattcgtttcggccgtcctttaacgaggcctaggtacggtaactccccgagccgtaggtttaccgacggtcggaccgtaggttcggggtacctaggggtacctttcggttacctacttccgtaccaacccgtacttaaccgaaaaccttaaccgtgtaacctaacgttcgtacggtaaccggttacgttttacggtacttaaggttttactttacgttcggttaccgtaacggtcttaacggttacccttaggaaacgttaccgtcggttacccgttaccgttaccggtttccgggacggggtaaaccgggaccgtaacggttcggaaccctaccggaaaccgttaacgtcggtcggtcgtacggacctaccgtacttccgttagttccttaccgtaccttccccgtaccctaccgtagttaccg

SEQ ID NO: 5898 - DNA, 877 bp, Homo sapiens
  misc_feature: GYAE6OF02GDXU1.8.28.C06.1.454.CMB.1.raw
  modified_base (114)..(114): a, c, t, g, unknown or other
  misc_feature (114)..(114): n is a, c, g, or t
  modified_base (198)..(198): a, c, t, g, unknown or other
  misc_feature (198)..(198): n is a, c, g, or t
  modified_base (359)..(359): a, c, t, g, unknown or other
  misc_feature (359)..(359): n is a, c, g, or t
tcagctcgcgtgtccacgaccggtgctcgatttagagctcacgtattgggtttgggggaggaactgctcagttagggacccagacggaaccatggaagccccagcgcagcttcncttcctcctgctactctggctcccagagatcattggagaagtggtgatgacacagtctccggtcaccctgtcttgtttttccgnggggagtagacgcctaccgtcctccgtgtcggcggcctaagtccgagacggtaccgttagggaccgtaacttacggccgttaggtatcgagacaggaggcctaggcctacggcctccgaacgtctcctacgtacttcgttacgggcctacccgtttaaacncgggtcctaaggttcggaaaccttcccgtacggacccgtaacgggttaccgaacggtccggtacgtaacgggtttcggggtaccgttacggggttaaccgttttcggttacccaaccgtttcgtacccctaacgtaactttaccgaaaactttaacccgtagtaacctaacgttccgtacggttaaacggttacctttacggtaaccgtttacgttttacgtttaaccgttcgtaccgttaagggtacccttaggtttaccgttaacggttaaaccgggtaccgtcggggtttaccccgtttaaacccggtttacgggttcccgggggtttaaccgggaaccggggtaaaccggttaaacggggttaccggtaacccttttaaaacggaaacccgggtttagttaccggttacggggtacctttcgggaaccctttaaacccgggtacttaccgtttaacccgggttacctttcgtaaccctttacccgggtttaccccgtacgttacgttaacccgg

SEQ ID NO: 5899 - DNA, 579 bp, Homo sapiens
  misc_feature: GYAE6OF02H6LTG.8.28.C06.1.454.CMB.1.raw
  modified_base (195)..(195): a, c, t, g, unknown or other
  misc_feature (195)..(195): n is a, c, g, or t
  modified_base (390)..(390): a, c, t, g, unknown or other
  misc_feature (390)..(390): n is a, c, g, or t
  modified_base (406)..(406): a, c, t, g, unknown or other
  misc_feature (406)..(406): n is a, c, g, or t
  modified_base (549)..(549): a, c, t, g, unknown or other
  misc_feature (549)..(549): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctccagagatcattggagaagtggtgatgacacagtctccggtcaccctgtcttgtttttccgnggggagagagccacctctcctgtgcggccagtcagagtcggttaggacgtaacttagcctggtatcagcagaggcctggaccaggcctcccagacctcctacatctttggccgtaccgtttaacgcgggtacctagtcggaactccgagccgtagttcgaggcgagtaggtgggtctgggtactttcgtcactcncacatactaactactnactaactctacgacgtactttgacttagtttactttcgtgtacagtctagttctagtaagtcgtcggtccgttactacgttcgggacggtaggacgtaggtcgactaacgaacgatggtcgacgtcgacctacgtacttcgtnttcctctaccttcctacccgtctattacgg

SEQ ID NO: 5900 - DNA, 606 bp, Homo sapiens
  misc_feature: GYAE6OF02HHX3L.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (378)..(378): a, c, t, g, unknown or other
  misc_feature (378)..(378): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagactccnctatctttggccgtcctttaacgagggccaggtacggaactcccagccgaggttcaggtcggcaggtggtcgtgggtacttcgttcnctctcaccatacaaactacctgacaatctacgacgtactttcgacttagttttacttctcgtcacgtctagtctaggaagtaccgtcggttccgttaccttacggtttcgggacgggtaacgggaaccgtaaggggtacggtacctaacgaaaccgtaagtcggtcggtacgtcggaccaccgtacgtccgttgttccttacacctttcccgtccgtacctcttaccg

SEQ ID NO: 5901 - DNA, 820 bp, Homo sapiens
  misc_feature: GYAE6OF02GDCW8.8.28.C06.1.454.CMB.1.raw
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcacctgtctgttttccngggganagagccaccctctcctgtgccggccagtcagagcgttaaggactaacttacgcctggtatcgagcagaggcctggaccagggcctcccgagacctcctctacttcgtttcgggccgtaccttttaacggacggggtccctaagggtacggtaaactccccgaaggtaccgtaggggtttaccaacgggccgggtacctaggggtttcgggggttacgttacgggggtaacctttttccggtttaccgtaaccgtttccgtacctaacccgtaacttaacctaaaaacgttaaaccccgttaggtaacctaaacgttaccgtaacggtaaccgtttaacgtttttacggtaacctttaaggttttttaacctttccgttaacggttaccgtaacggttacgtaacggtttaccgtaaaggtaaccgtaaccggtttcgggttaccccggttttacgtacccggttttacgggggacccggggttaaacgggtaacccggttaaagggttccgggtaaacccttaaacgggaaaccgtaacggttcggtcggtaccgtcgaccgtaaccctacgttccgttacgttccttacgtacccttcccgttacccctctacgttaccgg

SEQ ID NO: 5902 - DNA, 736 bp, Homo sapiens
  misc_feature: GYAE6OF02JEEY8.8.28.C06.1.454.CMB.1.raw
  modified_base (159)..(159): a, c, t, g, unknown or other
  misc_feature (159)..(159): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (696)..(696): a, c, t, g, unknown or other
  misc_feature (696)..(696): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactcgtggctccagagatcattggagaagtggtnatgacacagtctccggtcaccctgtcttgtttttccgngggganagacgccctacccgtcttcctggtcggcggtacccaggtccaggacggtcggttaacgggactaaccgtttgcccgttagggtacttcgagcgtaaggcggtcccgtagggacccgaggtcccttaccccgaaggtcccttcctactacgtttcgtttcgggacctttaccgtttaaccgacggggtccaggttacgggaaccttcccggagtcccgtaacggttccgaggtccggtacgtagggtcgggttcgttacggggtacctttcggtacgccctctacccactaagttaccctaacgtacctcgactactacgtcgtaaacggttctttgtactttaacgttttacttttccgtagtaccgtacgtacgtagttacgtacggtaacgtaccgggtcgttaccggttaccgttacggtttcccgggagggttacgggaaccgtagggtccggaacgtaacgaacgtacgtgtcggtacgtcacctacncgttcttcgtcttcgtaccgttccgtacccgtctgtaccg

SEQ ID NO: 5903 - DNA, 745 bp, Homo sapiens
  misc_feature: GYAE6OF02G295G.8.28.C06.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagtatcattggagaagtcggtgatgacacagtctccggtcaccctgtcttgttttccnggganagagcccaccctctccgtgtagccggccagtcagagcggttagacaacttagcctggtactcagcagaggccctggccacggtcctccccgagtacctcctctacttcgtttcggcctccgttttaaacggacgggtcccgtaaggtttcggaaccttccccgaggtaccgtacgggtttaccgacggacggtacgtaggttccggggttctaggggtacctttccgggtttaccaacggttccctacgtaacccctagttacccaaacgttaacccgtgacctaacgtcccgttagaaccgtttacgtttacggacgtttagttttaacttccgttacggtacctacggaccgtttagttccgttaaggaaacgttcgtaccgggttaccgtttaccgttacgggttttaccgggacggggtaaccggaacggttagggtaccggtaaccacgtaaacgacgttggtacggtcgtccgaccgtaccggtaatttccgtaagtttccgttactaccgttcccgttccctacggttattaccgg

SEQ ID NO: 5904 - DNA, 779 bp, Homo sapiens
  misc_feature: GYAE6OF02IAVXU.8.28.C06.1.454.CMB.1.raw
  modified_base (137)..(137): a, c, t, g, unknown or other
  misc_feature (137)..(137): n is a, c, g, or t
tcagctcgcgtgtccacgaccggtgctcgatttagagctcacgtattgggtttgggggagaactgctcagttaggacccagacggaacatggaagccccagcgcagcttctcttcctcctgctactctggctccagngatcattggagaagtggtgatgacacagtctccggtcacccttgtcttgtttttccgggggagagacgcccacctcctcctggtcgcggccagtcagagtcgttaggacgtaacttagccttaggtatcgagccgaggacgggtcctacggccgaacggccttcccgaacgtaccttcccgttacctaatttcccggttttcgggcccgtttacccgtttaaaacggacggggtaccctagggtaacgggtaaaccttccccgaacggtacccgtaacgggttaccgacgggtccgggcgtaaacgggttcggggttcgttacggggtaccgttttcgttaccgaccttaccgttcgaaccctaacgtaacctaaacgttaacgtcgtaactaacgttccgttacgtaaccggttactttacgtacgttttaacgttttacgtttacgtcggtacgttaagtaccgttaagtcgttaagtaacggtacgttaccgggtaccgtttaccgtacggtttccgggacggggtaccgggtaaccggtagggtaccgtaaccgtaaccgaaacgtacgtggtacgtacgtcgacctacgccgttacgtcgttaccttcgtaccttcccgttcccgtactcgttaacg

SEQ ID NO: 5905 - DNA, 693 bp, Homo sapiens
  misc_feature: GYAE6OF02I95I8.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccgngggganagagcccacctctctggcgcggccagtcagagcgttaggacgtaacttgcctggtatcagngagacggctggccacggcctaccagacctcctctacgttcgtttcggaccttaccgtttaacgacgggtcctaaggtacggaaccttcccgacgtacccgtaggttccgacggccggacgtaacgggtcggggttcgtagggttaccgtttccggtttaccacgttcctaccgacctaactaccgtaaacttaacccgtgtaacctattcgtacgtaccgttacgtttcgtacttagttttcttcgtacgtacacgtcgtattcgtagtaacgtacgtcgttccgttacgtaccggtttaccgggacgggtaaccggtacgtaacgggtaccgtaaacgtaaccgtaaacgtacgtcggacggtactcgaacctacgtaactcgttagttaccgttaccgtccgttacccgtaccgtacctacgtaaccg

SEQ ID NO: 5906 - DNA, 874 bp, Homo sapiens
  misc_feature: GYAE6OF02H4LT6.8.28.C06.1.454.CMB.1.raw
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgttttccnggggaagacgccacctcgtctgtgcggccagtcgagngcgttaggacaacttagcctggtatcagcaggacggcctggaccagtccgtacccagtacctcctactacttcgtttcggaccgttaccgtttaaacgcggggtcctaaggtacggtaaacttaccccgaaggtcccgtagggtttacgaacggtccgggtacgtaacgggtcggggttacccgtttaggggtaacccttttccgggtttacccgtacccttacccgttacccgaaacccttacttaaccggttaaaaccttaacccgtttacggtaaacctaaccgtttaccgggtacggtaaaccccgggttttaccttttacggtaaccctttttaaagggttttttacccgtttagtttaccgggtttactaacggtaacccgtttaacggttacgttaacgggaccgtttaccggtaaccggggttcccgttttaccgtaaacccgggttttcggggaccgggttaacccggggaaccggtttaaaggggtacccggaacccggttaaacgtaaacggtaccgtttacgggtaccggttaaccgtcggtaaacccctaaccgttacggttacccgttcggttttacccgttaaccgtcccgtttccccggtttaccccgtaccgttacgtttacccgg

SEQ ID NO: 5907 - DNA, 849 bp, Homo sapiens
  misc_feature: GYAE6OF02H961Q.8.28.C06.1.454.CMB.1.raw
tcagctcgcgtgtccacgaccggtgctcgatttagagctcacgtattgggtttgggggaggaactgctcagttaggacccagacggaaccatggaaggccccagcgcagcttctcttcctcctgctactctggctcccagagatcattggagaagtggtgatgacacagtctccggtcaccctgtcttgttttccgtggggagagacgcccaccctctcctgtcgcggccagtcagagtcgttaaggacgaattcgcctggtatcagcaggacggccgtggccgaggcctcccgagaccttccgtactagttcccgttttacgggacccgttacccgttttaaacggacggggtacccgttaagggtacgggtaaaccctaccccggacggtacccgtaaggggtttcccgaaacggggtccggggtccgtaaagggtccgggggttacggttacgggggttaccgtttttcccgggtttacccgtaaccgttcccgttaccgtaaaccctaacggtttaccctaaaaaccgttaaccggttacccgtaactaaacgtttaccgttaaccggtaaccgtttaaccggttttacgttaccgtttaaggtttttaactttaccgtttacgttaccgtacgttaccgttaagttacgttaaggtaacgtaccgtaccggttaccggtttaccgtaccgggtttcggaaccggggtacggtaaccggtaaagggttaccggaaaccgtaaccgtaaacgtaacggtacggtacggtccgtcgtacccgtaaccgtacgtttcgttacgtttccgttacctaccgtttcccgttccccgtaccctacgttaccg

SEQ ID NO: 5908 - DNA, 626 bp, Homo sapiens
  misc_feature: GYAE6OF02F464U.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (258)..(258): a, c, t, g, unknown or other
  misc_feature (258)..(258): n is a, c, g, or t
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (353)..(353): a, c, t, g, unknown or other
  misc_feature (353)..(353): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctgctcccagagatcattggagaagtggtgatgacacagtctccggtcaccctgtcttgtttttccngggganagagccaccctctcctgtgcggccagtcagagcgttaggacgtaacttgcctggtancagcaggaggcctggccaggcctccagactccncatcttcggctccttaacgnggccagtagactccagccaggttcagcggcgaggtggtacgnggtacttcgtcacgttctacacatacaataacctgacaatctacgacgtactttgacttagttttattcgtagtcagtcagtctagaaagtcgtcggtaccgttctaccggtttcgggacggaaggaaccgttaagggtaccgtaacccgttaaacgaaaaccgtacgttacggtacggtaccgtacggtaccctaacggtaaccttaccggttagtttacccgtttccgtaaaccgttttccccttacccccgggtacctacgttaacccgg

SEQ ID NO: 5909 - DNA, 759 bp, Homo sapiens
  misc_feature: GYAE6OF02JRQO0.8.28.C06.1.454.CMB.1.raw
  modified_base (166)..(166): a, c, t, g, unknown or other
  misc_feature (166)..(166): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (524)..(524): a, c, t, g, unknown or other
  misc_feature (524)..(524): n is a, c, g, or t
  modified_base (568)..(568): a, c, t, g, unknown or other
  misc_feature (568)..(568): n is a, c, g, or t
  modified_base (573)..(573): a, c, t, g, unknown or other
  misc_feature (573)..(573): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcagttggagaagtggtgatgacanagtctccggtctaccctgttctttcgttttccgnggganagacgcctacctctctgtgcggcctgtcagagtcgttacggaacgtacttagcctaggtactcacgcgaacggacggtcccgtcgggaccacggccctacccgtaacgcctttcccctacgtacgtttccgtttacgggacccgtttacccgttaaacggcgggtacccgtaggtaccggtaacctccccgaagtacccggtaagggttccgacgggtccggtaccggttagggttccgggggtacgtttacgggtaccgttttaccggtcctaacccggtttctacccgtaactaacgtaacctaaaccttaccgttnaccctagtcgttacgtacgtactttgactttacgtttcttcgtntacgngtacctagttacgacgtaacgtcgtcgggtcctttacgggtaccgtttccgggggtacgtaaacgggtccgtaacgggttccggactaaacggtaacgtacgttcggtaggtaccgtcgtaacctacggttaccgtcgtttaccgttcttaaccggccctttaccccggtacttacccgtagttcg

SEQ ID NO: 5910 - DNA, 743 bp, Homo sapiens
  misc_feature: GYAE6OF02F09GA.8.28.C06.1.454.CMB.1.raw
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (691)..(691): a, c, t, g, unknown or other
  misc_feature (691)..(691): n is a, c, g, or t
  modified_base (732)..(732): a, c, t, g, unknown or other
  misc_feature (732)..(732): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagngtcgttaggacgtaacttgcctaggtatcagcaggnggcctggccaggctcccgagactcctcattcgtttcggccgtacctttaacggacgggtccgaagggttacggaacctcccccgaggacccgtaggggtttccaacgggtccgggccgtaaggggttcggggttcgttcgggggtaacccttttccggttacctacccgtttcctaccaaccctacgttacctaaaacttaacccgtgtaaccaacttaccgtacgtaccgtttacgtttagttacgttagtttttaacgtttccgtgtacgtacgtacgttacgttcgtaaggtaacgtacgttcgggttacctttccgttaaccggttttcgggggaccggggtaacgggaccgttaaggggtaccgtaacccgtaacgaaacccggttagttcgggacgggtactcggaccctaacgtnttccggttacgttcttacccgttacttcccggtttaccccncgttactccgg

SEQ ID NO: 5911 - DNA, 785 bp, Homo sapiens
  misc_feature: GYAE6OF02I9NJA.8.28.C06.1.454.CMB.1.raw
tcagctcgcgtgtccacgaccggtgctcgatttagagctcacgtattgggtttgggggaggaactgctcagttaggaccagacggaaccatggaagccccagcgcagcttctcttcctcctgctactctggctccagagatcattggagaagtggtgatgacacagtctccggtcaccctgtcttcgtttttcctggggagagacgcctaccctctcctgtcgcggccagtcagagtcgttaggacgtaacttagccgtaggtactcgagcgaggaggtcctaggaccgacggccttaccccgagtacctcctctaacttccgttttgggccgtaccgttttaaacgacggggtaccctaaggttacggaaacttaccccgaaggtccccgtaacgggttaccaagggtaccgggacgtaacgggttcggggttaccgttacggggggttaacccgttttccgtttacgtaacctttccgtaacctaaaccctaacgttaacctaaaaacgttaacccgttgaacctaaacgttcctaacggtaacggttaactttacgttacgtttaaacgtttttacgtttacgtacgttacgacggttactaacggttccgttaaggaaacgtcgttacgggtccgttaccgttacggttaccgggacgggtaacgggaaccgtaaacgggttcggtaaccctaaacgtaaaccgtacgttcggacggtcgtcgaccgtactaacgttccttggttacttcgtactttccccgtacccgtacttactaccgg

SEQ ID NO: 5912 - DNA, 757 bp, Homo sapiens
  misc_feature: GYAE6OF02IVU8F.8.28.C06.1.454.CMB.1.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccagccacctgtctttgctccaggggaaanagccaccctctcctgcagggccagtcagaatgttggcgtccttacgtaagcttaggtaccaacacaaaacctggccaaggcctaccccaggccccctacactctaatggtcgctactaccaacgacgggccaacgtcggacaacttcccgaagcccgtaagggtttccaaggttcggaccgtaagggttcggggtaagttggggaaccaacggtaactttccgaacttccgtaccaaacccgtaatccaaacgttaccgacgtacccgttacgggaacgtcccgtaaggtaaacggtaagttcggtttaggtacttaacggttttaacttaaccgtttacgtaacctaaaccgtacgttaccggttaaccgtagggttccggggtaccccggttcccggggggtacccttaccgggttttacccgggaccccggttacgggtaacccggtaaggggtacggtacggtacggttaaccgtaaaaccgggtaaccgttgggtacggtaccgtacggacctaacccgtagttaccgttacggttccttacttaacccgg

SEQ ID NO: 5913 - DNA, 802 bp, Homo sapiens
  misc_feature: GYAE6OF02HGDU5.8.28.C06.1.454.CMB.1.raw
  modified_base (198)..(198): a, c, t, g, unknown or other
  misc_feature (198)..(198): n is a, c, g, or t
  modified_base (520)..(520): a, c, t, g, unknown or other
  misc_feature (520)..(520): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttcttgtttttccgnggggagagacgcctaccctctcctgtcgcggccagtcagtacgcgttaggacgtacttacgccgtggtactcagcaggacggtccgtggcctacgggcctccccgaggaccttccctactatttcccgtttcgggccgttacccgttttaaaccggacggggccctaacgggttcggaaccttacccccgaagtacccgtagggtttaccgaagggcccgggacgttagggttcgggggtaccgttagggggttaccccttttacggtccgtaccttccgtaccctaaaccctacgtaaccctaaacgttaaaccccggttntaaccgtaacgtttccgtaccggtaaccggtttaccgttttacggtaccgtttaacgtttttacgtttacctttcgggttacccaggttccgtaacggtttacggtaacggtaacgttaccgtccgggttcccgtttaccggtaccggttcggggtaacgggtacggggtaaccggttaacgggtaccgtaaaccgaaccggtaaccgtagtacggtggtcgtcgtaccgtactacgtcgttacgtcccttagtaccttccgtaccctcgtaccgttaccgg

SEQ ID NO: 5914 - DNA, 683 bp, Homo sapiens
  misc_feature: GYAE6OF02FQJDE.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (273)..(273): a, c, t, g, unknown or other
  misc_feature (273)..(273): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccaccctctcctgtgccggccagtcagagtcgttaggactaacttagcctggtactcagcaggnggccgtggccaggcctcccagacctccctcagttcgtttcggccgtacccgtttaacgagggtcccaaggtcggaactccccgagtcccctagggttccacggcggctagggtgggtccgtcggggtacctttcggttccacttcctccgaacctactactaaacgtaacccgttgactaacttctacggtaccttacgttttcgacgttaactttttacgtttcgtactacgtacgcgtacttacgtacgaacgtaccgtcggttcccgttaccgtaccggtttccgggacgggtacgggaaccggtaggtacggacccgttaacgaaacgtacccgttggacgtccggtcacccgtaccgtacttccgtagttcctccgttacttcccgttccccgctcgttaaccgg

SEQ ID NO: 5915 - DNA, 892 bp, Homo sapiens
  misc_feature: GYAE6OF02H3EF0.8.28.C06.1.454.CMB.1.raw
  modified_base (210)..(210): a, c, t, g, unknown or other
  misc_feature (210)..(210): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctccagagatcagttgggagaagtggtagatgacactacgtccgtccggtccacccgttgtcgtttcgttttcggnggggatacgacgccctacctctcgtggtcgcggcagtcgagacggtacgtaggacgtacgtacgcgtagtctcgagacgaggacggtccgtacggaccgcggtacctcccggaatccctacgtacgttacttccggttacggccgtttaacccggttaaacgcgggtacctaggtaccgggtaaccttaccggaacgtcggttaaccggttcgaccggggacggtaccgttgggtccggggttacgttacggggtaacctttccgggttacaaccgtccggttaccgaactttacgtaaaccggtaactttaaccggacgtaccgttaacgtccggttaaccggtacggtttacggttacgtacgttttaacgggtttacttacggtaccgtaagtaccggtcgttacggtaacgtacgggtaaacgtaccggttaccggttacggttaacccggtttacgggtaacccgggggttaaccggggtaaaccgggttacccggggttaaaaccgggttacccggtaacccggttaaaacggtaaaacccggggtttccgtacgggttaaccgggttacccggtaaccggtaaccccggttaccgttaaccggtttcccgttaccggttaccggttaaccccttcggttaacccccggttaccgttacccggtcgttaacccggg

SEQ ID NO: 5916 - DNA, 928 bp, Homo sapiens
  misc_feature: GYAE6OF02J1AP4.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgtggggagagacgcccaccctctccgtgtgcggccagtcagagcgttaggacgaacttagcctggtatcagcaggacggcctggccaggcctcccagtacccttccctactacgttccgtttcgggaccgttcccgttttaaacgaccgggggtaccctaagggtacgggtaaacccttcccccgaaggtccccggtaacgggtttccaacggggccgggtacgtaacggggttcggggtccggttacggggttaccttttccggtttacccgtaccgtttcccgtacctaacccttaacgttaccctaaaaacgtttaaccccgtacggaacccgtaaacgtttcctaaccgggtaaaccggtttaccgttttacgggtaaccttttaagtttttaaccgttttccgttcggtaaccgtagggtacccgttaaacggtttccggttaaacggtaacgggttaacccggtttcgggttaaccccgttttacccgttaccggggttttttcccggggaaccggggggtaaaacccgggggttaaacccggttaaacgggggttacccgggttaaacccggttaaaccccgggtaaaacggtttaacccgggttgggtttacgggtacccgtaagggtaaccccctaaccttacggttttacccgttaccgttttaccggtttacccgttaacccgtttccccggtttaccccgacccgttacgtttaaaccccgg

SEQ ID NO: 5917 - DNA, 825 bp, Homo sapiens
  misc_feature: GYAE6OF02F4RVW.8.28.C06.1.454.CMB.1.raw
  modified_base (595)..(595): a, c, t, g, unknown or other
  misc_feature (595)..(595): n is a, c, g, or t
tcagctcgcgtgtccacgaccggtgctcgatttagagctcacgtattgggtttgggggatggaactgctcagttaggacccagacggaaccatggaagccccagcgcgagcttctcttcctcctgctactctggctcccagagatcgattggagaagtggttgatgactactaggtctcccggtacacccttgtacgttggtttttccctgggggacaggtagcccacccgtctccgttggtcgcgggccgacgtccaagcgtcgttaggtaccgaacgttcgaccgttggtactcaagtccagtaacggtcctacggccaaggtccctaccccaaggtacccttacccgtactacgttcgtttcgggaccgttcccgttttaaccggaacggggtcccgttaagggtacgggtaaacttccccgaggtacccgttaacgggtttaccgaacggttacggcgtaacgggttaggggttccgtacggggttaacctttccggttacgtaccgttcctaccgtaccccgtaacgttaccaaacgttaaccgtcgaacgtacttactacggtaccgtacgttcgaacgtttacgtttnttaccgttcgtacgtaacgtacgtacgttccgtagtaaaccgttcgtaccgggtcctttaaccgtacccggttacgggtcgggtaaaccgggttaacgggtaaacgggtcccggtaaaccggttaacgaaacccggttacgttacggtacgggtcctaacgggtaccacccgttaacgttccgtaacgtttccttaccggttacctttcccttacccggtaccttaccgg

SEQ ID NO: 5918 - DNA, 769 bp, Homo sapiens
  misc_feature: GYAE6OF02J2WWM.8.28.C06.1.454.CMB.1.raw
  modified_base (694)..(694): a, c, t, g, unknown or other
  misc_feature (694)..(694): n is a, c, g, or t
tcagctcgcgtgtccacgaccggtgctcgatttagagctcacgtattgggtttgggggaggaactgctcagttaggacccagacggaaccagtggaacgccccagcgcagcttctcttcctcctgctactctggcctcccagagatcattggagaagtggtgatcgacacgacgttccgtccggtccacccgttgttcgtttacggtttttccggagggggtacacggtaccgcccctacccgttcgttccgtggtcggaccggtaccaggttacacgggtacggtaccggttaacggaacgtaacgttacgcccggttaggtaactccgaggtaccgaggtaccggtccgtacggccgacggtccccctacccgacggttacccttccggtactacgtttccgttcgggtacccttaaccgttaacggcggaccgtaggtaccggtaaccctccggaacgtccggtacggttccacggtcggtacgtaggttccgggttagtccgggtcctttccgactccgtactaccgaaccgtacttaacaccgttaccgtcgtaccgtaacgtccgtacgtacgttacgttacgtcgtttaacgttttctcgtacgtcgagttcgtacgtcgtagtacgtcgtccgttcttacggaccggttaggtccggacggtacgtacggcctacgacgtaaccgngtcgacggttcacgtaccgtctaccttcgtacgtttaccgttaccgaccgtttcccgtccgtacgttcgtaccgg

SEQ ID NO: 5919 - DNA, 768 bp, Homo sapiens
  misc_feature: GYAE6OF02GO3Y9.8.28.C06.1.454.CMB.1.raw
  modified_base (205)..(205): a, c, t, g, unknown or other
  misc_feature (205)..(205): n is a, c, g, or t
tcagctcgcgtgtccacgaccggtgctcgatttagagctcacgtattggggtttgggggaggaactgctcagttaggacccagacggaacccatggaagccccagcgcagcttctcttcctctgctactctgcctccagagatcattggagagtggtgatgacacagtcctccggtccaccctgttcttcgttttccgagggganacgacgccctaccctctccggtgtcggccggacctaggtacaggagtacgggttaaggacctaacgttcgccttgggtactacggagtacgacggacgggccgtacggacccgtagcccttaccccgacgtaccttcccctatacgtttacggttccggtaccgttaaccgtttaaccggcgggtaccgtacggtacgacccttccgacggtccgtaggttacgacgggcggtacgtagggtcgggttcgttaacgggttccgtttccgtttacgacccgttttaccgtaccgaacccttagttaaccctaaaccgttaacccccgtggtaaccctaacggttccgtacggttaaccgttacgtttaccgtttacgtttaacgttttacgtttccgtaggttccgtagtcgtaacttcggtaagtagttaccgtacggtttcccgtcgttacgtcgggtacgacgggtacgtacggggtacaccggtaacgtaacgtgtcgtaggactggaactacgtacgttctacgtcttctacccggttcctacccggttcacgttacgg

SEQ ID NO: 5920 - DNA, 716 bp, Homo sapiens
  misc_feature: GYAE6OF02F9O9A.8.28.C06.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagagccaccctctcctgtgcggccagtcagagcgttaggacgtaacttagcctggtatcagcagaggcctggccaggctcccagacctccncattcgttggcctacctttaacgngggtccaggtcggaactccccgaagcctaggttcacggcggcgtaggtcggggtcgttcggggtactttccggttcacgttcctaccgaacctacgttaacccaaacccgtaacccttgaccctaaacttccgtacggtaacccgtacgttttcgtacttagttttactttacgtacgttacgacgtacgtagttcgtacgtaacgtacgtacggtccgtttccgtaccgtttcgggaccgggtaacggggaaccgttaaggggtaccgtaacccgtacgtaaaaccgtacgttacggtcggtaccgtcggaccgtacccttaaccgttccgttaccgttaccggtttacccttacccggtttacccgtttaccccggttacccgtaccgttacccggg

SEQ ID NO: 5921 - DNA, 773 bp, Homo sapiens
  misc_feature: GYAE6OF02HILJF.8.28.C06.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctccagagatcagttggagaagtggtgatgacacagtctccggtcacctgtcttcgttttcgnggganagacgccacctctccgtgtgccggcagtcagngtacgttacggactactagcctggtactcngacaggacggccgtcggacctacggcctcccgagtacctcctctacttcgtttcggccgttaacctttaacggcggtcctaaggtcgaaccctccgaggaccgtaggttcacggcggacgtacggttcggggtctacggggtccttcggttccacttcgactacctactacaacgtacgtcgtactacgtcgtacgtacgtacttcgtacgtttaacgttttacttaccgtcgttacgtacggtaccgttagttacggtacggtaaacgttaccggtttcccgggttaaccgttttaccggttaaccggggtttttaccgggggaaccgggggttaaaccgggtaaacccgggtttaacgggggttacccggtaaacccgttaaaccgggaaaaccggttaacccgggtggttaaaccggtccgtaccggtaaccgttaaaccgttcgttaccgttaccggtttaccttcccgaccgttttcccccgttaccgtcctaacgtttaccgg

SEQ ID NO: 5922 - DNA, 739 bp, Homo sapiens
  misc_feature: GYAE6OF02H5JTJ.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagccttctcttcctcctgctactctggctcccagagatcattggagtaagtggtgatgacacagtctccggtcacctgtcttgttttccgnggggatagacgtcccacctctccgtggtcgccggacctaggtacgagtaggtacggttaacgggaaccgtaagttacgcctagggtactcgaacgtcgaaggcggtccgtacgggaccaacgggtcctacccgacgtcttcctacgtagtacgtttcggccttaaccgtttaacggacgggcctaggtacggtaactcccgaggtaccgtacggttcgacgcggactagggtcggtcgtgggtaacttcgttacgtactctacaacctataacgtaacctactgtacctatcgtacgtacgttacttacggtacttacgtttattcgtacgtactacgtacgttactaacgtacggtaagtaccggtcgttaccggtttactaaccgggtttacggggaccgggtaacggtaacccgtaacgggtacgaaaccgttaaccggaaacgtaccgttacgggtacggtacctaaccgacccgtaacgtacttacccggtagtttaaccctcgttaacccgtccccttaacggtccgtaataccgg

SEQ ID NO: 5923 - DNA, 820 bp, Homo sapiens
  misc_feature: GYAE6OF02IEOK5.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (780)..(780): a, c, t, g, unknown or other
  misc_feature (780)..(780): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacgacagtctcggtcaccctgtcttgtttttcngggganagcgccaccctcgtcctgtacggcgccagtcagacgtcggttaacggacgtaacgttcgccgtgggtaactccgagaccgtaaggacgggcctcgggccaagggtccctaccccgaagacccttcccgttactaattcccgtttacggtacccgttacccgttttaaacggaccgggtccgtaaggtacgggtaaaccttccccgacgaccgttagggttacacgggtaccgcggtaacgggttcggggtacttacggggtaaccttttccggtacctaccgtccgttaccaaccgtaacttacgtaaaacctaccgttaccgtaccgtaaagttcccgttaacgggtaaccgttacgttttcggtaacttttaacgttttacgtttacccgtgttccgagtacccgttaagtccgttaaagggtacgttacgtaaccgggttcccggtttacttaaccgggtttcccgggaccggggtaacggtaccggttaagggtacccggtaacgaaacggtaaccgtagttacgggtctaaccgttccgaaacgtacccgttacgttacctacggttacccgtnttaacccccttccggtttaacccctccgtaagttccccgg

SEQ ID NO: 5924 - DNA, 726 bp, Homo sapiens
  misc_feature: GYAE6OF02GMFV0.8.28.C06.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggccagtcgagagcgttaggacgaacttagcctggtatcagcagnggcctggccaggcctcccagacctcctacattccgtttggccgtacctttaacgcgggcctaggtcggaactcccgagccgtaggttccaggcggctaggttcggggtctacggggtacctttcggttacacgttcctaccaccgtatacctaaaacttaaccctggtaactaacgttacgtacggtaaccgttaccttttaggtacctttagttttaacgtttcgtacgttaccgtaggtcttacggttcgtaaggtaacgtccgttacgggtcccggtttacgttaccggtttaccgggggacggggtaaccgggtaaccggttaacgggtaccggtaaacccttaacgtaaaccgtaaccgttcggtacggtaccgtacggtacccgtaacctaagtttccttacggtttaccctttcgttaccgtttccccgtttaccccgtacgttaccgttacccg

SEQ ID NO: 5925 - DNA, 775 bp, Homo sapiens
  misc_feature: GYAE6OF02FNP7J.8.28.C06.1.454.CMB.1.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacactagtctccggtcaccctgtctgtttttccnggggtanagagcctaccctntcctgtacgccggccagtcgagacgcgttaggaacgaacttagccgtaggtactcagcaggacggcctaggccaggcctaccagacctcctcattcgttacggccgtaccttaacgacggcctaggtcgaacgtcccagtccgtaaggttcaacggcggtacgaggttcgggtcgtagggtacctttcggtcaaccgttccgtacctacccgtaagttaacccgtaaacttaaacccgtggtaccctaaacttaccggtacgaaaccgtttaacggttttccgtaccggttaagtttttaccgtttaccgttaggtaacccttaaggtaccctaaaggtttcccggttaaagaccgttaaccggtggggttacccgttttaaccctaccgggtttaccggggaccgggtaacggggtacccgtaaagggttccggtaacccgttaagaaacccggtcgtagggaccgtacgttaacggaccctaacccgttaacgttcgtttacccgtacgtttcccgtaaccgtttacccccgttacccgaccgttaattacccggg

SEQ ID NO: 5926 - DNA, 615 bp, Homo sapiens
  misc_feature: GYAE6OF02FYM5T.8.28.C06.1.454.CMB.1.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggganagacgcccaccctctcctggtgccggccagtcagagcgttaaggacgtaacttagcctggtactcagcagtacggcctggccaggcctacccagacctcctacattcgtttggcctacctttaagcggccaggtggaactcccgagccgtaggttcaggtccggacaggttgggtactgggtacttcggttcaacgtctacactatccaaacgtaacctgacatctacgtactactttgacttagtttacttctacgtcagtcagttcagtaacgtactcggtaccgttacacggtttcgggacgggacggtaaccgtaaggttacggaacctaacgaaacgcgtagtcggaccgtgacctactacgttctacggttactcgtaaccttccgttacccgacctagtaaccg

SEQ ID NO: 5927 - DNA, 778 bp, Homo sapiens
  misc_feature: GYAE6OF02I041A.8.28.C06.1.454.CMB.1.raw
  modified_base (199)..(199): a, c, t, g, unknown or other
  misc_feature (199)..(199): n is a, c, g, or t
tcagctcgcgtgtccacgaccggtgctcgatttagagctcacgtattgggtttggggaggaactgctcagttaggacccagacggaaccatggaagccccagcgcagcctctcttcctcctgctactctggcctcccagagatcattggagaagtggtgatgacactagtcctccggtcaccctgtcttgtttttccgnggggtagagacgcccaccctctccgtggtcgccgccgagtcagagtcggttaggacgtaacttagcctggtatcgagcgagtacggccgtcggaccgacggtcctacccgagtacctccgtctacgttcgttcgtccgtaccgtttaacggcggtaccgtaggtaccggtaacctacccggacgtaccgtacggttaccgacggtaccggtacggtaacggttcgggtacggttacgggtacccgttttccggtacctaccgttacccgttaaccgaacccgtaaacttaacccgtaaaacgttaacccgtagtaacctaacgttaccgttaacggtaccgtttacgtttacggttacgtttaacgttttacgttcgttacgtactacgtacgtacgttacgtaacgtaacgtaccgtccggttaccgttaccggttaccggttccgggtacggggaaccggtaacggtaaccggttacgggtaaccctaacgttaaccgtacgtgtacggtcgtaacgtccaacgttctaccgttcgttacttccgtaaccgttccccttaccgtccttacgtaccgg

SEQ ID NO: 5928 - DNA, 814 bp, Homo sapiens
  misc_feature: GYAE6OF02H8YBA.8.28.C06.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
tcagctcgcgtgtccacgaccggtgctcgatttagagctcacgtattgggtttgggggaggaactgctcagttaggacccagacggaacatggaagccccagcgcagcttctcttcctcctgctactctggcctcccagagatcagttggagaagtggtgatgacacagtcctccggtcacctgtcttgttttccgnggggagagacgcccaccctctcctgtcgcgcagtcagngtacgttaggacgtaattcgcgtggtactcgagacgaggacggtccgtcggaccgacggcctacccgacgtaccttccgtactacgtttccgtttcgggacccgtttacccgttttaaaccggaccgggtacccgtaacggtacgggtaaccttaccccgacgtcccggtaacggtttaccggacggccgggtacggtaacgggttcggggtttaccggtttcgggggttaccttttaccggtttcccgtaaccgtttcccgttaccgtaaccctaccgttaaccttaaaccgttaaccgtcgtaacctaacgtacgttacggtaaccgtttacgtttacgttacgtttagttttactttcgttacgttcgtacgtacgttacgttacgtacgtaacgtacggtaccggttccgtttaccgttaccggttccggtaccgggtaccgggtaacggtaacggtaccggtaaccgtaaccgtaaaccgtccgtaaaacggtcggtacggtcgaccgtaccgtaccgttcgttacgttaccttaccgttacccgtttcccgttcccgttacccgtactaccgg

SEQ ID NO: 5929 - DNA, 716 bp, Homo sapiens
  misc_feature: GYAE6OF02HS8X5.8.28.C06.1.454.CMB.1.raw
  modified_base (400)..(400): a, c, t, g, unknown or other
  misc_feature (400)..(400): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttcgtttttccgtggggagagacgcccaccctcctcctggtcgcggccagtcagaggtcgttaaggacgtaacttacgctggtatcagcaggacggcctgggccaggcctacccgagtacctcctactacgttccgttttcgggaccgttacccgtttaacggacggggcctaacggttcggaaacttccccgaagccgtacggttcaggtccggngacggttcgggtccgttggggtaccctttcgttaccacgttcctaccaacctactacctaaactaaccctggtaacctattccgtagtaaccgttacttcggtactttaacgttttattcgttcggtactacggtactacggttctaacggaacgttacgtccggggttaccctttaccgggttccggtttaccggggacggggtaaacggggtacccgtaaaggggttacgtaccgtaaaccgtaacggtactggtcggtcgtacgtacctaacgtctcgtagttcttaccaccgtttcctacccgtctacgtcg

SEQ ID NO: 5930 - DNA, 791 bp, Homo sapiens
  misc_feature: GYAE6OF02GZICV.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcagttggagaagtggtgatgacacacgtctccggtcaccctgtcttcgttttcgtggggagagacgccacctctcctgtcgcgcagtcgagacgtacgttacgacgtaacttagccgtaggtactcgacgcgaggacggtcccgtgggaccacgggtccctaccccgaacggtacccttcccgtactacgtttccgtttcggggacccttaaccgtttaaccggaccggggtcctaacgggtaccggtaaccttaccccgaaggtacccgtacgggtttccaacgggtccggtacggtaacggttcggggtaccggttacgggttaccttttccggttactaaccgttcctaccctaaccgtactaactaaacgttaccgtcaactacgtactacggtaacgttactttacggtactttagttttacttcgttcgtaccgtaagtctacggttcgagtaacgtccgttcgggtacccgttacgttaccgggttcgggaaccgggtacggtaaccgggtacgggttaaccgaccgttaaaccgaacggttacgttcgggtaggtacccgtacggtaccgttaacctcgttaccgttaggttcccggtttaccctacggtttaccccgtacccgtccgtacgttaaccggg

SEQ ID NO: 5931 - DNA, 827 bp, Homo sapiens
  misc_feature: GYAE6OF02HHXIE.8.28.C06.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccgngggganagacgccaccctctcctggtcgccggccagtcaggacgtcggttacggaccgtaacgttcgccgtggtactacgaggacacggacggccgtcgggccgacggcctccccacgaccttccctatacttcgttcggtaccgtacctttaacggacgggtacctagggtacggaacctacccgacggaccgtacggttaccgaggcgggaccgtagggttcggggtacggttcgggttacccgttttcggttaccgtacccttccgttacccgacctaaacgttaccgtaaaacttaacccgtacgtaaccgttaccttaccgtacggttaccgttacggttttacgtaccgtttagtttttaccgtttacgttcggttaccgtaccggtaacttaccggttaacgttacgggtaacgttaccggttaccgggtttacccgtttaaccggttaccgggttttacccgggggacgggggttaaaccgggtaaccgggtaaacggggttaaccggtacccggttaaaccggtaaaccggttacggttagggtccggtaccgtcgtaacccgtacggtaactttcccgtactttcgttacctccttaccccgttacccctcgtactaccgg

SEQ ID NO: 5932 - DNA, 579 bp, Homo sapiens
  misc_feature: GYAE6OF02FU6IB.8.28.C06.1.454.CMB.1.raw
  modified_base (196)..(196): a, c, t, g, unknown or other
  misc_feature (196)..(196): n is a, c, g, or t
  modified_base (399)..(399): a, c, t, g, unknown or other
  misc_feature (399)..(399): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagccaccctctcctgtcgcggccagtcagagcgttaggacgtaacttagcctggtactcgagcgagaggcctggccaggctccagactcctactacttcgttcgggcctcctttaacggcgggccaggtcggaactcccgagccgtaggttcaggcggacaggtcgggtcgtagggctttcggtcactccgtacncctatacaaacgtaccgtgactaacgtcgtgaacgttcttcgtacttagtttacttcgtgtactgactagtctagacgtctcggtccttacgacgttcggacggtaacggacgagggtcgactacgaacgtacgtgcggcgtgcctacgtctcgtattcctctactcctccgactgtacg

SEQ ID NO: 5933 - DNA, 777 bp, Homo sapiens
  misc_feature: GYAE6OF02GOR85.8.28.C06.1.454.CMB.1.raw
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgttttccgtgggganagagccaccctctcctgtgccgccagtccagacgcgttacggacgtaacttacggccttagggtactacgagtcgaggaggccctgggaccagggccttccccgaaggtccttcccgtactacgtttaccgtttcgggacccgttaccttttaaaccggacggggtccctaagggttcgggtaaaccttcccgaaggcccgtaacgggttcccaggccgggtacgtagggttacggggtcgtcggggtaaccttttccgggttactacgttccgttaccaacccgtacttacctaaacggttaccctagggtacctaacgttccggtacggtaccgttaacgtttcgtacgttagttttacgtttctaggttcctacggtctacggttactacggtaaacgtccgttcgggtaccgtttacggttaccggttacgggaccggggtaaccgggtaacggtaacgggtccgtaaccgacggttaaacggaccggttcggtaggtaccgtcggtaccgtacccttaggttccgttagttacccttcgtaaccgtttcccgtacccgtcctaagttcccgg

SEQ ID NO: 5934 - DNA, 710 bp, Homo sapiens
  misc_feature: GYAE6OF02FGLC4.8.28.C06.1.454.CMB.1.raw
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
tcagctcgcgtgtccacgaccggtgctcgatttagagctcacgtattgggtttgggggaggaactgctcagttaggacccagacggaaccatggaagccccagcgcagcttctccttcctcctgctactctggctcccagagatcagttggagaagtggtgatgacacagttctccggtcaccctgtcttgttttaccgngggganagacgcctacctcgtactggtcgccggacctagtctagacgtcgttaggacgtaacgttgccgtaggtactcagtcaaggtacgccgtggccaggcctcccgacgactcccgtacacgttcgtttcggcctaccgtttacgacggtccgtaggtacgaactcccgagccgtacgtcgagcggcgtcggtaggtacgtcgggtacttcgtacgtactacgtctaacccgtatacgtaactacgtcgactacgtactcggacgttacttacggtactagttttacgttcgtacgtacgtaagtccgttattacggtaacgtacgtaaccggttccggtttacccgttcgtaccggttttaccggggacggttacgggtaaccggttaacggtaccgtactaaccgtaacggttaaccggtgtaacggttccgtaacgtcccaacgttaccgttccgttacgttaccttccgtttaaccgccctttaccccgactttaccttaccgg

SEQ ID NO: 5935 - DNA, 752 bp, Homo sapiens
  misc_feature: GYAE6OF02F3E6X.8.28.C06.1.454.CMB.1.raw
  modified_base (197)..(197): a, c, t, g, unknown or other
  misc_feature (197)..(197): n is a, c, g, or t
  modified_base (479)..(479): a, c, t, g, unknown or other
  misc_feature (479)..(479): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggtagagagcccaccctctcctgtcgccggcagtcgagaggtcggttaggacgtaacttacgccgttaggtactcagcgtacggacgggtccgtggcccgaggcccctaccccgagtaccctcctacgtacttccgtttcgggtccgtacccgtttaacggacggggtaccctagggtacggtaacctccccgaagccccggtaggttccgaggcggcgtagggtcgggtacgtggggtacctttcggtacacctcgtacacctactacaacttaccgtnacctaactcgtagtaccgttactttcgtacgtttagttttacgtttactcggtacgtcgtaacgtagttacgtacggtaacgtaccgttccggtacccgtttaccgtaccgggttttccgggaaccggggtaacgggtaccgttaaacggggttaccgacccgttaaacggtaaccggtaacgtcggttacgggcgttaccggtaccctaacgttaccgttcgttacgttaccttacgtacccgtttcccggtcccgttacctacgttacccg

SEQ ID NO: 5936 - DNA, 702 bp, Homo sapiens
  misc_feature: GYAE6OF02I76BR.8.28.C06.1.454.CMB.1.raw
  modified_base (160)..(160): a, c, t, g, unknown or other
  misc_feature (160)..(160): n is a, c, g, or t
  modified_base (196)..(196): a, c, t, g, unknown or other
  misc_feature (196)..(196): n is a, c, g, or t
  modified_base (412)..(412): a, c, t, g, unknown or other
  misc_feature (412)..(412): n is a, c, g, or t
tcagctcgcgtgtccacgaccggtgctcgatttagagctcacgtattggggtttgggggaggaactgctcagttaggacccagacggaaccatggaagccccagcgcagcttctcttcctccttgctactctggctccagagatcattggagaagtggtnatgacacagtctccggtcaccctgtctgtttttccnggggataggacgccaccctctcctgtcgcggcagtcagcgtcgttaggactaacttagccgtggtactcagtcaaggcggcctgggcccaggcctaccccgagctccgtcatttcgttcgcgtacctttaacgaggggcctaggtacggtaactccccgaggtccctagggttacaggccggtgtaccggttgggtccgtcgggtcttcgttaccncgttacctcctaccacgttaacctaaacgttaccgtcaacctaacgttcgtacggtaccgtacgtttcgacttacggtttttaacttcgtcgtactacggagtcgtacgttacgaaccgtccgtcggtaccctttacgtcgtttacggggccgggtaacggaaccgttacgggaccgtacccgtaacgtaaacggtaccgtggtaccgtacgtcggtaccaccggtacttaccggttaccgtttacgttacctaccgtttacccctcccggttacccgcttaaccccggg

SEQ ID NO: 5937 - DNA, 691 bp, Homo sapiens
  misc_feature: GYAE6OF02I0YOH.8.28.C06.1.454.CMB.1.raw
  modified_base (151)..(151): a, c, t, g, unknown or other
  misc_feature (151)..(151): n is a, c, g, or t
  modified_base (166)..(166): a, c, t, g, unknown or other
  misc_feature (166)..(166): n is a, c, g, or t
  modified_base (205)..(205): a, c, t, g, unknown or other
  misc_feature (205)..(205): n is a, c, g, or t
  modified_base (264)..(264): a, c, t, g, unknown or other
  misc_feature (264)..(264): n is a, c, g, or t
  modified_base (317)..(317): a, c, t, g, unknown or other
  misc_feature (317)..(317): n is a, c, g, or t
  modified_base (354)..(354): a, c, t, g, unknown or other
  misc_feature (354)..(354): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattgganaagtggtgatgacanagtctccggtcaccctgtcttcgtttttcctaggggganagtagccacccttctcctgtgcggccagtcagagcgttaggacaattgccgtagttacnagcagcggcctcggcaggcctccgagacctcgtacattcttcggctcttacgnggtccagtcggactccagctagtcaggcgagagtggngtagggcttacgtcacgtctaccgactaagtctaaaacgtactcgacaacgttctaaggtaacttaacgttagacgtttaagttttcttacgtacggtactacgtagtacttacgtaacgaacgtaccgtaggttaacccgttcgttaacggttccggggtaaaccgggtaacgggttaaccggtaaacggggtttacccggaaccgttaacgaaaaaccgttccgttacggggacgttaccgtacgggtaccctaaacccggttcgtttaacccttcggtttaccttaccggttaactttacccccgggttacccttaacggttacctttaaccgg

SEQ ID NO: 5938 - DNA, 775 bp, Homo sapiens
  misc_feature: GYAE6OF02JO9U0.8.28.C06.1.454.CMB.1.raw
  modified_base (207)..(207): a, c, t, g, unknown or other
  misc_feature (207)..(207): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcagttggagaagtggtgatgacacagtctccggtccaccctgtcgtttgtttttccgtgggganaggacgtcccacccttctcccgttggtcggcggacctagtcgagaggtcggttaggaccgtaacttagccttaggtactccgagcgacggacggccgttcggccacgggtcctccccgagtacctcctactattcgttgtccgtacctttaacgcgggacctaggtacggtaaccttccccgacgacccgtaacgggtttccgaaggcccgggtgtaacgggttcggggtaccggtttacggggtaccctttttccgggtttacctaccttcccgtacgtaaccctaacttaccgaaacttaaaccgtcgacctaaatttccgtacgttaaccgttaggtttacccgttagtttacggtttttaatttccgttcgttaacgtagttaccgttattccgtagtaacgtaccgttcggttacgtttccgtacgtttacggtacggacgggtaaccgacgttacgggaaaccttacggaaacgtagttacgtcggcgttcggaacctaccgtacgttcccgttagttcgttaccggtccttttacccggtacccttacgtacgttaacccg

SEQ ID NO: 5939 - DNA, 635 bp, Homo sapiens
  misc_feature: GYAE6OF02IRZ4R.8.28.C06.1.454.CMB.1.raw
  modified_base (196)..(196): a, c, t, g, unknown or other
  misc_feature (196)..(196): n is a, c, g, or t
  modified_base (232)..(232): a, c, t, g, unknown or other
  misc_feature (232)..(232): n is a, c, g, or t
  modified_base (354)..(354): a, c, t, g, unknown or other
  misc_feature (354)..(354): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagacgccaccctctcctgtgcgcagtcagngcgttagacgtaacttagcctggtatcagcagaggcctggccaggcctcccgagactcctcattcgtttggcgtcctttaagacgggccaggtggaactcccgagccgaggttcaggccggnaggtgggtcgtggggactttcgttcactctaccactatacaaatacctgactaatctagtacgtactttgcttagttttatttcgttagttacgacgtcgtagtacgttagaacgtacgtccgggttccgttacgtaccggtttccgggacgggtacggggaacccgtaaacggggtcggaaccttaacgaaacgtactgggtacggtacgtcggaccctaacgtacgttacgttacggtcctttaccgtcgtttccccgttacccgtaccctacgttccg

SEQ ID NO: 5940 - DNA, 866 bp, Homo sapiens
  misc_feature: GYAE6OF02H7PQL.8.28.C06.1.454.CMB.1.raw
  modified_base (207)..(207): a, c, t, g, unknown or other
  misc_feature (207)..(207): n is a, c, g, or t
tcagctcgcgtgtccacgaccggtgctcgatttagagctcacgtattgggtttggggagaactgctcagttaggacccagacggaacatggaagccccagcgcagcttctcttcctctgctactctggcctaccagacgatcagttggagaagtggtcgagtgacacagttcctaccggtcaacccgttgtccgttacgttttccgnggggtagacgtacgccacctccgtctaggtcgcggactagtcgaaggtcgtacggttacggaaccgtaacttcggaccgttggtacgttcgaggtacggacggtaaccggtcctcgggaccacgggtcccttacccgaacgttacccgtacctaccgttaagtttcccggtttttaaccggacccttttaaccccggttaaacgtaccccgggggtaccttaacgggttacggttaaaaccccttccccggtaaacggttccccggttaaacgggttttaccggaaaccggggtcccggttaacggggtaaaccgtttcggggggttttaccgtttaccggggtaacccgttttaccggttacccgtaaaccgggtttaccttaccggtaaaaccctttcggttaaaacccttaaaccggttaaccctggtttaaacctacgtttaccgtacgtaaaccggttttacgtttcccggtaagttttacgttaaccgtttcgtaacgttacggacgtcgttagtacctaggtaacgtcgtacggtctcgttacgtcgacggtaggaccgtaggtaccacgtacaacgtcggtataccgtagtcctaaccggcttaacgtcctacgttacctacgttccgtacccgtaccgtctacgtaccgg

SEQ ID NO: 5941 - DNA, 647 bp, Homo sapiens
  misc_feature: GYAE6OF02G0JWY.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagactcctcacttcgtttggcgtcctttaacgacgggccaggtggaatcccgagccaggttcaggcgcagtgggtctgggacttcgtcactctcacatcaactacctgctaatctagacgtactttgcttagtttactttctcgtctagtctagttactaggaacgtacgtcgggtacccgttacgtaccgttttccgggacggggtaacgggtaaccgtaacgggttacgggtaccctaacggtaaacgtaaccggttacgggttcgggaccgtttcgggacccgttaacccgtacgtttaccgttacggttaccttttcgaacccgtttccccggtttacccccgtaccgtacgttacccgg

SEQ ID NO: 5942 - DNA, 842 bp, Homo sapiens
  misc_feature: GYAE6OF02GUDDT.8.28.C06.1.454.CMB.1.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctccagagatcattggagaagtggtgatgacacagtctccggtctacctgttcttgtttttccgngggganagacgcccacccttctccgtggtcgccggccagtcgagacggtcggttaacggaacgtaacgttacgccgttaggtactacgaacgtacgaaggacggtcccgtagggacccgacggtccctaaccccgacgtacccttcctacgtacgtttccggtttacgggtacccgttaaccgtttaaaccggcggggtacctaacgggttaccgggtaaaccctcccggaacggtccgtaacgggttccgaacgggccgggtacgtagggttcggggtaccgttacggggttacctttaccggttacccacggttcctacccgtaacctaacgttaacccgtaaaacgttacccgagtaaccttaacgtccgtaacgtaccggtttaactttacggtaacgtttagtttttaacgttccgttacgtacgtacgtacgttacgttacgtaacgtaaccgtacgttccggtttaccgttacggttacggtttccgggaaccgggtacgggtaaccgtaacgggttaaccggtaacctaaacggtaacgtaacgttcgggtacgtccgtaacgtacccgtacttacgttccgttacgttacgttacccgttaccgttaccccgttaccggtaccttagttaccgg

SEQ ID NO: 5943 - DNA, 698 bp, Homo sapiens
  misc_feature: GYAE6OF02GT325.8.28.C06.1.454.CMB.1.raw
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtagatgacacagtcctccggtcaccctgtctcgtttttcgnggggagagcgccaccctctcctgtcgcgcagtcagngcgtagacactgcgtgtncagcaggacgccgtagccaggtcctcccgagaccttcctactcgttcgttcggccgttacctttaacggacgggtccaggtacgacctacccacggtccgtaggttccgacggcggtacgtaacggttcgggtcgtacgggttacttccgttactaaccgttcctaccgtaaccgttactacgtaaaccgttacctacgtacctaacgtttcgtacggtaacgttaccgtttacggtacgttttaaagtttctttaccgtgtaccgtacgttaacgttcgttacgtacggtaacgttccgttcggttccgtttaacggtcggttaccgggaacggggttacgaaccgggttaacgttcggtaaaccgtaaacgaacgttacgtcggttacgcgtcgtaccacggtctacgttcgttacctcggtacctcccgtacgcttatcccgg

SEQ ID NO: 5944 - DNA, 772 bp, Homo sapiens
  misc_feature: GYAE6OF02G6ED5.8.28.C06.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgcccaccctctcctgtcgcggccagtcagagcgttaaggacgtaacttacgcctggtatcagcagacggcctggccaggcctcccagacctcctntacttcgttcggccgtaccttttaaacgacgggtccaaggttaggaacctcccgaacgccgtaggttaccgaacggcggtcgtaggtcggggttcgtacggggtacctttccggtttacaccgttcctaccaaacccgtataacctaaacgttaacccgtagtaccgtaacttcgtacggtaaaccgtttacgtttacgtaaccgtttagtttttactttcgtacggttccgtaacggtccgtaacgttaccgtaaggtaaccggtacgttcgggttacccgtttccgttaaccgggttccgggtaccggggtaacggtaacccgggttaagggtaccggtaacccttaaaccgggtaaaccgtaacggtttccggtacggtaccggtaccggtacctaacccggttaacttcccggtttactttaccgttaccttaccgttccccgtttacccgccgttacgttacccgg

SEQ ID NO: 5945 - DNA, 672 bp, Homo sapiens
  misc_feature: GYAE6OF02GU0T0.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggcagtcagagcgttaggacgtaacttagcctggtatcagcagaggcctggccaggcctccagactcctctatcgtttggacctcctttaacgagggtccaggtcggaactcccaagcctaggtccagcggcaggtcgggctagggactttcgttcacgtctacacataaactacctgactaatcagtacgtaacttttgaccttaggtttatttcgtggttcagtctaaggtcttacggaagtacgttcggtacccgtttacgtaccggttttacggggaccgggtaacggggtaaccggtaacggggttacctaaccccggttaacgaaaaacgggttaaccgttcggggtacgtcccggttaacgtcccggtaaccttaaccggttccttaggttttccccttacgtacgtttaccccgtttaccccgacgttacgttccgtaaccggg

SEQ ID NO: 5946 - DNA, 762 bp, Homo sapiens
  misc_feature: GYAE6OF02F3HMA.8.28.C06.1.454.CMB.1.raw
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
tcagctcgcgtgtccacgaccggtgctcgatttagagctcacgtattggggtttggggggagaactgctcagttagggaccccagacggaaccatggaagccccagcgcagcttctcttcctcctgctactctggctcccagagatcaattggagaagtggtgatgacacagtctccggtcaccctgtctgtttttccnggggtanagagccaccctntcctgtcgcggccagtcaggacgtcgttaacgacgaacttagcctggtatcagcaagaggcctggccaggcctacccaaggaccctccctacaccttcgtttcggcctacccgttttaaacgacgggtacccgaggttacgggaaactccccgaagtacccgtagggttaccgacggtcgggacgtagggttcgggttcgtacgggggtacctttcgggttaccacgttcctaccgaacccgtacttaccgaaacttaaccccgtcgacctaaccgttacctacggtaaccgtaccgttttccgtacgttaacgttttactttctacgtaccgacgttactacgttacgtacggtaacgtaccgttcgggtcccttaccgtaccggtttcgggtaacgggtaccggtaaccggtaacgggtaccggtaaccgtaccgaaaccggtacgttacggtacggtacggtacggaaccgtaccgtaaccgttaccgtaccggttaccttaccggtaccttacccgttaccccgtacctacgttacccgg

SEQ ID NO: 5947 - DNA, 752 bp, Homo sapiens
  misc_feature: GYAE6OF02GEEC9.8.28.C06.1.454.CMB.1.raw
  modified_base (201)..(201): a, c, t, g, unknown or other
  misc_feature (201)..(201): n is a, c, g, or t
  modified_base (689)..(689): a, c, t, g, unknown or other
  misc_feature (689)..(689): n is a, c, g, or t
  modified_base (706)..(706): a, c, t, g, unknown or other
  misc_feature (706)..(706): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctcggcctcccagagatcattggagaagtggtgatgacacagtcctccggtccaccctgtcttcgttttcgnggggagagacgcccaccctctcctgtcgccggccagtcaggagtacggttagaacgtaacgttagccgtggtatcgagacgaggacggccgtggacccgaacgggtcccctaccccgaaggtacccttccctacgtactttccggtttcgggacccgttccttttaaaaccggacggggtccctagggttacgggaaaccttccccgaagggtacccttagggttccgaacggtccggacgttagggttccgggttggtcgggttaccttttcggtaccgtacttcctacccaactaacgttacctaaaacttacccgtgaactaaccgttcgtaacgtaccggttaactttcgtacgtttattttcgtttcgtacgtctacggtacttagtactaggtaaaccgtcgtccgggttacgtttccgttaccgggttcggggacgttaccgggtaacggtacggtaccgacctaacggaacgagttcggngtcgtcaacctacggtnttcgttcgtacctttcgtaccgtttcccgtaccctacgtacgtccg

SEQ ID NO: 5948 - DNA, 872 bp, Homo sapiens
  misc_feature: GYAE6OF02FWUUQ.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccnggggagagagccaccctctccgtgtgccggccagtcagagacgttaggacgtaacttagccttggtactcgagtccaggacggccgtggaccctaagggcctaccccgacgtaccttcccgtacctactttccgtttcgggacccgttacccgttttaaccgacgggggtaccctaacgggttacggaaaccgttaccccgaacggtccccggtaaggggttttacccgaacgggtcccgggtacggtaaggggtttccgggggttaccgggttacgggggtaacccttttccggtttacccgtaaacccgtttccgttaacccgaacccgtaacgttaacccgtaaaacgttaaaccccgtcggtaaccgttaaaccgttacccgtaaacgggttaacccgttaaccgttttacggtaccgtttaaaggttttttacctttaccgttacgttaccgtacggttaaccgttaggttaccgtaaggtaaaccggtaccgttaccgggttacccgtttacgttaccggtttacggggaccgggtaaaccggggtacgtaacgggttacggtaacccttaacggtaaaaccggttcgtacgggtacggtaccgttacggacctaacctcgttaccgtcggttaccttccgtaccgttcccttcccggtactcgttaccgg

SEQ ID NO: 5949 - DNA, 786 bp, Homo sapiens
  misc_feature: GYAE6OF02HAI96.8.28.C06.1.454.CMB.1.raw
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattgggagaagtggtgatgacacagtctccggtcaccctgttcttcggtttttccgnggggagagacgcccnccctctccgtggtcgccggcctaggtcacggaggtcggttaagggaaccgtaaactttcgccgttggttaactcgacgtacgaaggacggtccgtcgggccacgggtccctacccgacgtacctccgtactacgttccggtttcggccgttacccgtttaaaccggcgggtacccgtaaggttacgggaaacctcccgaaggtcccgtaacggttcgacgggccggcgtagggtcgggttaccggtcgggtactttccggttactacgttccgactaccgtataaccgtaaactaaccgtgtaacctaacgtcctacggtaacttcgtttacgtacgtttaagttttacttcgtcgtacgtacgtacgttacgttcgtaacggtagtaccggtttcggtccggttttaccttaccggggttacggggacgggttaacggggtaaccgtaacgggttacccgggtaactaaaccggtaaaccggtgttaccggtggtaacccgtcgaacccttaacggtcttaccggttctttaccgttacttccggtcccttacccgtacctagttccg

SEQ ID NO: 5950 - DNA, 733 bp, Homo sapiens
  misc_feature: GYAE6OF02HMEF4.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (468)..(468): a, c, t, g, unknown or other
  misc_feature (468)..(468): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtcttgtttttccngggganagacgccaccctctccgtgtgccggccagtccaggagtcgttaacggacgtaacttcgcctggtactcgagcaggacggccgtcggccaggcctcccgagtacctcctnacgtttcttcggccgtacctttaaccggacgggtcctaggttacggaacttcccgacggtacccgtaacggttccaagggtccggacgtaggttcggggtcttcgggtaacctttccggtactaccgttcgaccaaccgtactacctaaacttaaccngtaacacgttccgtacgtaaccgtttacgtttacgaccgtttaagtttttacttcgttacggtctacgtaactggttaactacgggtaactcggttacgttacccgttaaccgttccgggtttacgggaaccggtaaccgggaaccgtaaggggttaccgacccgtaaagaacccggttagtcgggtacgtcggtaccgaacccttacgtaacgttccgtttacgttacttacccgtaccgttccccgtccgtactaccgttcgg

SEQ ID NO: 5951 - DNA, 793 bp, Homo sapiens
  misc_feature: GYAE6OF02JO9Z1.8.28.C06.1.454.CMB.1.raw
tcagctcgcgtgtccacgaccggtgctcgatttagagctcacgtattgggtttgggggaggaactgctcagttaggacccagacggaaccatggaagccccagcgcgagcttctcttcctcctgctactctcggctcccagagactcagttggagaagtggtagtactcgacacgagtccgtccgtcacccttgtcttcgttttccgtgggacgtaagacgtcctacccgtcgtccgtggtcgaccgtcgacgtaccagtacggtacggttaacggacgtaacgttcgccgttaggactacgacgcgaagcggtacgacggtaccgaccgtctaccgacgtactcctacgttacgttccggttacgccgttaccgttaacgacggttaccgagtaacggtaccgtcccgacggttcgtaacgtgtacgcggtacgtcggtcggtaacggttggtaccgttccgttacacccggttcaccccgtaacgacttaacgaacccgttataccggtactacggtcctacggaacttacgtacgtctttaccgtttattacgttccgtaccgttaaggtactacggtaacgtaccggtaacgttacgttaccggtttacgttaaccgtttaccggggtttaccgaacgggggtttacggaaacccgttaaacggggacccgttaccgtaaacggttaaaccgtaacgggttcgtaaccgggtcgtaaacccggcttaaacccgacgtttcgtcccgtttaacgtcgttaacccgtccgtacggtacccgtcttaaccgg

SEQ ID NO: 5952 - DNA, 785 bp, Homo sapiens
  misc_feature: GYAE6OF02HO59O.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcaagttggaagaaggtggtagatacggactacacgtccgtccggtaccaccctcggttctttcggtttttccgggagggggaatacggaccgcccctacccgtcgtccgtgggtcgacccgggacctagaccgaaggtcggtacggttaaacggaacccgtaagttccggccgtagggtaactcgacgtagacggtacggccgtaggacctacgggtccctacccgagtaccccttacgttacgtacttttaccggttaggccccgtttaaccttaaacggccggaccgttaacggttacgggtaaaccctccccgacggtaccgtaagggttcccgaacgggcggtaccggtggtacggggttaccgtcgggtacctttccggtacactcccggtactaccgatccggacgaccacgtaccgtacggcgtcgttaaagttaaggttacttacgtacggtaatttacgtacctacggttacaaacttcgtaccggttaaccgagttcccgggccggtttcccggtacccggttacgttcccggaccgttaacggaaaccttagtcgaagttactaacgacggtacttggacgtcgtagaccctacgacttggtacgttcctatccgtaccgttccacgtcg

SEQ ID NO: 5953 - DNA, 592 bp, Homo sapiens
  misc_feature: GYAE6OF02FRR4O.8.28.C06.1.454.CMB.1.raw
  modified_base (201)..(201): a, c, t, g, unknown or other
  misc_feature (201)..(201): n is a, c, g, or t
  modified_base (268)..(269): a, c, t, g, unknown or other
  misc_feature (268)..(269): n is a, c, g, or t
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (586)..(586): a, c, t, g, unknown or other
  misc_feature (586)..(586): n is a, c, g, or t
tcagctcgcgtgtccacgaccggtgctcgatttagagctcacgtattgggtttggggggaggaactgctcagttaggacccagacggaaccatggaagccccagcgcagcttctcttcctcctgctactctggctcccagagatcattgggagaagtggtgatgacacagtctccggtcaccctgtcgttggtttttccgngggggagacgacgcccaccctcttccgtgtggccgggcaggtcagcgcgtagagactagcctggtanngcagngctggccnggcctccgngtactcncacttcgttcgctccgttacgacgggccaggtacactccgacgccgtaggtcagcgcgaggtcggtgtggtaccttgttcactctacacctatacgtaactcctagctaatctacgtacgtatcggtacgttatttacgtttactcggtactaagtcgtacgtcgagtaagcctacggtcgtttccgtacggttacggcggtacggacggtacgacggtacctaacggaccgtagtacgtcggacgtcgactacgtcgttctcgttctccgttcttcccgtacccgtntcgtcg

SEQ ID NO: 5954 - DNA, 843 bp, Homo sapiens
  misc_feature: GYAE6OF02GP8CV.8.28.C06.1.454.CMB.1.raw
  modified_base (126)..(126): a, c, t, g, unknown or other
  misc_feature (126)..(126): n is a, c, g, or t
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (238)..(238): a, c, t, g, unknown or other
  misc_feature (238)..(238): n is a, c, g, or t
tcagctcgcgtgtccacgaccggtgctcgatttagagctcacgtattgggtttgggggaggaactgctcagttaggacccagacggaaccatggaagcccagcgcagcttctcttctcctgctacnctggctccgagagatcattggagaagtggtagatgacacagtctccggtcacctggtctgtttttccgngggtagagacnccgcctctcctgtcgacggtcctagtcgaagngtacgttaggaaccgtaacttcgtccgtaggtattaccgagacgtaacggtacggtaccgtcggtccgaacgggtccctaccccgaacggtaaccgtcccttacgtaaccgtttccgttacggtcccgtacgttttaaccgacggtaccgtacggtaccgtaaacgtcccgtaacgtccgtaacgggtttcgaaggtccggacgttacgggttggggtcgggttacggtaacgttttccgggttacctacggttccttaccaacccgtattaacccgtaaacgttaaacccgtcggtaacctaaacgtttccgtaaccgggtaacgtttaccgtttaggtaccgttttaaggttttaccgttttaacggttggttaccgttacgttacgtaacgtttcgggtaaactaaacgggtcccggtttaccggtccggtttaacccgttaccgggtttccggggaacccgggtaacgggtaaccggtaggttaacccggtacctacggaaaccgttacgacgtacggacccggttacgaccctacgtacgtttacccggttgttaaccgtttccgttacctaacccggtttccgtaacccgtgttaccgg

SEQ ID NO: 5955 - DNA, 712 bp, Homo sapiens
  misc_feature: GYAE6OF02GQY1C.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcacccttgtcttgtttttccgnggggagagacgcccaccctctcctgtgccggccaggtcaggacgtcggttaggacgtaacttgcctggtatcagcaggagcctggccaggcctcccagacctcctcattcgttcggccgtactttaacgacgggtaccagttcggaactccccaggacctacgggttccacggcggacgtagggtcgggttcgtacggggttacttacggtttccgaccttcctaccgaaaccctatacctaaactaacccgttgacctaaacgtcgtacggtaaccgtacgttttcgacttaacggtttttacttcctttaggtctaaggttcctaggttacctaggtaaaccgtcgtaccggtccgttacgtaccggttaccgggacgggtaaccggaaccggtaacgggttacggtaacctaaaccgtaaaccggtacgtcggtacggtacgtccgaccgtaacctcttaccgttaccttccgttacctaccgtttacccgtcccccgtactacgttaccgg

SEQ ID NO: 5956 - DNA, 635 bp, Homo sapiens
  misc_feature: GYAE6OF02ITKST.8.28.C06.1.454.CMB.1.raw
  modified_base (207)..(207): a, c, t, g, unknown or other
  misc_feature (207)..(207): n is a, c, g, or t
  modified_base (378)..(378): a, c, t, g, unknown or other
  misc_feature (378)..(378): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagtttcagataccaccggagagattggtgttgacacagtctccagccacctgtctttgctcaggggaangccacctctcctgcaggccagtcagatgttggcgtcttcgaagcgtagtaccaacacaaacctggccagcctacccacggcccctcactctatgggtcacactccaacgacgggtccacgtggccactacccgagaccctaggttcaggtggccgtaagggtcgggttagngggaacacgtacttacaccgtcaccacactcacgctacgctagacgtcctagaagttatttagacttagtttacttacgttcgtactaacgtagttacgtaccggtagtccgggaccgttcccgggggaccttccggttaccggtcccggttacgggtaacgtacgggtacggaacgtacgtaccggaaaccggtggtaccggtacggtaccgtcgaacctaccgtacgtccttacggttcttccctagtttccccg

SEQ ID NO: 5957 - DNA, 858 bp, Homo sapiens
  misc_feature: GYAE6OF02HD08W.8.28.C06.1.454.CMB.1.raw
  modified_base (211)..(211): a, c, t, g, unknown or other
  misc_feature (211)..(211): n is a, c, g, or t
  modified_base (593)..(593): a, c, t, g, unknown or other
  misc_feature (593)..(593): n is a, c, g, or t
tcagctcgcgtgtccacgaccggtgctcgatttagagctcacgtattgggtttgggggaggaactgctcagttaggacccagacggaaccatggaagcccagcgcagcttctcttctcctgctactctggcctccgagagatcagttggagaagtggtagatgacactagtcctccggtccacccgtgtcgtttcgttttccggagggganagaccgccctacccgttctccgtggtcggccggcaggtcaggtacggtacggttaacggaaccgttaaacgttcggccgttaggttacacgaacggtacgaagggtacggtccgtacgggcccgaaggtccccttaaccgacgtacccttacctacgttacgtttccggttttaccgggacccgtttaacccggtttaaacgggaaccgggtacccgtaagggttaccggtaaacccgtaccccgtaacgggtacccgttaaagggttcccgaaacggggtcgggtacgtaacgggggtttcggtaccgggtttacggggtaaccttttcggtttaccacgtttccgtaaccctaacgtacttaaaccgaactttaaccggngtaacctacgttactacgtaacgttacgtttgtactttaagttttacttcgtagtactagttacgttacgtacgtaacggtacttcggttccggtaccggtttacgttaccgggttcgggaacgggtacccgggtaaacggttaacgggtacccggtaaccgtaaaaccggtaagttaccgtggttaacggtccgtaacgacccgttacgttacgttcgtaccgttacttccgtaccttccccggttactacccgtacgttacgg

SEQ ID NO: 5958 - DNA, 805 bp, Homo sapiens
  misc_feature: GYAE6OF02F9GOM.8.28.C06.1.454.CMB.1.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccgagagatcagttggagaaggtggtagatgacacagtcctccgtctaccctgttcgttgttttaccggngggganagtacgcctaccgttctcgtgtcggccgacagtcaggacgtacggtagaaccgtaacttacgtccgtaggtatcgagtacgaggaccggtccgtacgggacctaccggtcctacccgtaaggtacctcctacgtacttacggttcggtacccgtactttaaacggccggacgtaacggtaggaccttaccggcgtaccggtaacggttacgacgggtccggtaacggtcgggtttacggggtcggtaccgggtttaccgtttaccgttacggtaacccgttcccttacgaaccccgttaattaacccctaaaagtttacccgtacggaacttaacgtaccgtaacggtaacgttccgtttaggtacctttaacggtttactttacgtacggttactacggttacctacggtttaagaacgtacgttacgtaccgggttcccgtttaacgtacgggtttccggaacgggtaaccggtaacgaacggggttaccgaaacgttaaccggaaagttacgtggtacgtaccgtacgacctaaccgtacggtttctacgtttacgtaccgttaccgttccttacccgaccgttataacgg

SEQ ID NO: 5959 - DNA, 1004 bp, Homo sapiens
  misc_feature: GYAE6OF02HV7H9.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtcctccggtcaccctgtcttgttttccgngggganagacgccacctctccgtgtcgcggcagtcaggagtacggttacggacgtaacttcggcctggtatcgagcgagaggccgtggaccacgggtcctacccgacggaccttcctacctacgtttccgttttcggaccgttaccccgttttaaacggacggggtacctacgggttacgggtaaacctccccgaacggtacccgttacgggtttaccgacgggtaccgggtacggtaacggggtttcgggggtttacgggttacgggggtttaccccgtttttaccggtttacccgtaacccgtttacccgttacccgtaaccccgttaaacttaaacccgtttaaaacccgttaaacgttacccgggtaactttaaaccgttaccgtttaacgggttaaccccggtttaaaccgtttttaccggttaaacccgtttttaacgttttttaaacgttttccgtttacgttaacccggttacgtaacccggttaaacgtttcggttaaccgggtaaaaccggtttaccgggtttcccgggttttaacccgggttttacccggtttaccgggtttttaccccggggggaccgggggtttaaaacccggggtaacccgggtttaaaccgggggtacccgggtttaaacccggtaaaaacccgtttaaaacccgggtaccggttaccgggttacgggttaccgtaacccggaaccccgttaaccggttaaccgtttccgtttacccggtttactttaccccgggtaacgttttcccccggttaacccgtcccggtttaaacctttccgggg

SEQ ID NO: 5960 - DNA, 595 bp, Homo sapiens
  misc_feature: GYAE6OF02FHZJ2.8.28.C06.1.454.CMB.1.raw
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (319)..(319): a, c, t, g, unknown or other
  misc_feature (319)..(319): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttttcctgggggagagagccaccctctcctgtgcggccagtcagagcgttaggacgaacttagccctggtactcagcagaggcctggccaggcctcccanacctcctcactctttggccnccttttaacncgggccaggtggaactcccagcctaggttcagcggcaggtgggtctgggcttcgtcnctcnccacactcaatacctgacatctgactactttgctagttttacttctgtctagcagttccgtagaacgtacgttcggtccgttactacgttttccggaccggggtaagggacccgtaagggttccgaccgtaccgtaaaacgtacgttgtacggtcttcggacctacccgtagttcgttcgttacgtttccaccgttccttccccggactactccg

SEQ ID NO: 5961 - DNA, 1024 bp, Homo sapiens
  misc_feature: GYAE6OF02G6DH4.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtccaccctgtcttcggtttttccgtgggggagagacgcccacccttctccgttggtcgccgggacctaggtaccaaggtacggtaccggtttaacgggaaccgtaaacgttttacggcccgttagggttaacttccgaaggtaccgaagggaccgggtccccgttacggggaccccgtaacggggccccttaccccgaacggtacccctttccccgtacctaacgttttcccggtttttcggggaccccggtttaccccgtttttaaaccggacgggggtaccccgtaaggggttaccgggaaacccttacccccggaacggtaccccggttaacggggtttaccggaaccgggtcccggggtaccgttaaggggtttaccggggggttaccggtttacggggggttaaccctttttacccgggttttacccgtaaacccgttttcccgttaacccgtaaccccgtaaacgttaccctaaaaccgtttaaaaccccgttggtaaacctaacgtttccgttacggtaacccgttttaacggttttcgttaaccgttttagttttttacgtttaccgttacggttacctaacggttaccgttaacggttcgttaaacgggtaaccggttaccggttaccgggttacccggtttaccggtttaaccggggttttccgggggaaccgggggtaacgggtaaccgggttaaacggggtcccgggtaaacctaaccggaaccggttaacggttacggggtacggtaaccgtcggaccgttaaccgttacggttccttacggtttacctttaccgttacccgttttaccccgtaccccgtaccttacgttacccgg

SEQ ID NO: 5962 - DNA, 697 bp, Homo sapiens
  misc_feature: GYAE6OF02GPFJ1.8.28.C06.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgtcttgtttttccgngggganagacgcccaccctctcctgtcgcggccagtcagacgtcgtacgacgtaactacgtcncgtatacncgagacgacggaccggtcgccgacggccgtaccctacgtactccctctaacttcggtttcggtacgtaccgttaacgtacgggccgtaagttacggaaccgtcccgtacgtaccggtacgttacggacgcggacgtaggttcgggttcggtggtacgttcgttctacgtcctactaccgactataaccgtaactcgtactaagtacctagtaccgttactttacgtgttacttttagttcttacgacctggtactactcgggttaagcggtactccggggttcctttaccgtaacggtttccgggacggggtaacggtaaccggacggttaaccgggtacctacgtaaacgtaccggttgcgtcggaccgtacaccgtagttacgttcgttctttaccgtacgttcccgtaccgttacctgttacccg

SEQ ID NO: 5963 - DNA, 828 bp, Homo sapiens
  misc_feature: GYAE6OF02H33A3.8.28.C06.1.454.CMB.1.raw
  modified_base (211)..(211): a, c, t, g, unknown or other
  misc_feature (211)..(211): n is a, c, g, or t
  modified_base (334)..(334): a, c, t, g, unknown or other
  misc_feature (334)..(334): n is a, c, g, or t
  modified_base (556)..(556): a, c, t, g, unknown or other
  misc_feature (556)..(556): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctcggctcccgagagatcattggagaagtggtgatgacacgagtcctccggtcaccttgtccttgtttttccgtggggacgngacgcccaccctctcctggtgcggaccacgtcgagacgtacgttacggacgtaacgttacgccgttaggtactcgagccaggaccggtccgtcggacccgacggccctccgacgacccttccncgttacttccgttttcgggacccggtttaccgttttaaacggccggggtacccgtaaggtccgggtaacccttaccccgacggtacccggtaacggtttcggaacggtccgggtacgttacgggtcggggttacgttacgggtcctttcggttactcgtaccttaccgactattaccgaactaaccgtcgactacgttccgtaggtacctacggttttaacnccgtttagtttttacttaccgttcggtacgtacgacgttagttcgtaacgacggtccgtttacggggtcccctttaacgtccgggtttccgggtaccggggaaaccggggtttacccggtaacgggggttaccgtaaacccggtttaaaccgaacgtaccgggttcggttaacggtccgtaccgggttaacccgacgttaacgtttccccgggttattccccggtttaacgtccccgttttaacggttccccccgttcgtaagtttccccgg

SEQ ID NO: 5964 - DNA, 860 bp, Homo sapiens
  misc_feature: GYAE6OF02J0IMM.8.28.C06.1.454.CMB.1.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (532)..(532): a, c, t, g, unknown or other
  misc_feature (532)..(532): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctcccagagatcagttggagaagttggtagatcgacacagtcctccggtcaccctgtctttcgtttttccgnggggangtacgccctaccctcttccgtgtacggccggacctagtccagtacggtaccggttaggaactaacgttacggcctaggtactcgagtcgaggtacggccgtggacccgacggtaccctacccaggtaccctcctaccgtaagttccgtttcggcgttaccctttaaaccggagggtcccgtaaggtacggaaccctcccggtacaccgttaaggttccggaaccggccgggtacaggggttcggtccggtacgggttcctttaccggttcccgtaaccgttctacccgtaaccgtacgttacctaaaacgttaaccccgngtaaccctaagtaccggttacggaaacccgttttaccgtttacgttaccgtttaaacgtttttacgtttccgttacggttaccgtaaccgttagtttaccggttactacggttaaccgtacttaccgggttaccgtttaccggttaaccgggtttccggggtacggggttaaccgggtaaccgggtacgggttaccggtaaacccgttaaccgtaaccggttaaccggtacggtcgggtacgtaccggaacccgttaaccgtacggttaaccgttccgttaccgtttaccgtacccgtttcccggtacccttaccaccggtttaccgg

SEQ ID NO: 5965 - DNA, 716 bp, Homo sapiens
  misc_feature: GYAE6OF02JEMPL.8.28.C06.1.454.CMB.1.raw
  modified_base (202)..(202): a, c, t, g, unknown or other
  misc_feature (202)..(202): n is a, c, g, or t
  modified_base (669)..(669): a, c, t, g, unknown or other
  misc_feature (669)..(669): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtcgtccggtcacccgtgttcttcgtttttccgnggggtagagacgcccacccttccgtccgtgtcggccggcctagtcgaggtagtacgggttacggaacgtaaccttacggtcctaggttacacgaggcgtacggacggcctcggaccgtaaggccctcccgagtacctccgtattacgttcgttcggccgttaaccgttaacggacgggtcacggttacggaacctccccgagtaccgtacggtacgacggtcggacgtaggtcggggtacgtacgggttccttcggttaccgtaccgtccgtaactacgtaactaaaccgtacgtacctcgtactactcgtacgtacgttacgttacgttacgttactttttattccgttacgtacgtacggtcgttacggtacgtaacggtaacgtggttacccgttaccgttcgttaccggttacgggtacggtacggtaccggtacggtacgaccgtaaacgacgtacgtggcncgtacgactcgtacttcgttctctaccgtctcctacgtctacgtacg

SEQ ID NO: 5966 - DNA, 785 bp, Homo sapiens
  misc_feature: GYAE6OF02JLY2Y.8.28.C06.1.454.CMB.1.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
  modified_base (257)..(258): a, c, t, g, unknown or other
  misc_feature (257)..(258): n is a, c, g, or t
  modified_base (703)..(703): a, c, t, g, unknown or other
  misc_feature (703)..(703): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtcctccggtcacctgtcttgtttttccgnggggagngagccaccctctcctgtgcgccagtcagagcgtagacgaacttgctgtntcannagagcgtgcacgctcccagtacctcctctacttcgttcggccgttacctttaaccgagggtcctaggtacggaacctcccgacgccgtacgggttccgaacggccgggtacgacgggttacgggttaccgggttcgggggttaccctttccgttttacgaccgtttccctaccgtaaaccctattaaccctaaaaccgtttaacctacgacccttaaacgtcgtttaaccggtaccgtttaaccgttttacggttaccgtttaaacgtttttacgtttccggttcgtttcgaacggttcttaacggttagttacgaaacccggttcgttaccgggtttccgtttaccgtttaccgggttccggggaccggggtaacgggtaaccggttaacgggttacccggtaaaccgtaaccgtaaacgttaaccggtttggggacccggttntcccgggtaaccaccgggtacttacggtttaccggtttaccttccgttaccgtttaccccgtttccgtaactaggttacccg

SEQ ID NO: 5967 - DNA, 630 bp, Homo sapiens
  misc_feature: GYAE6OF02F2QZG.8.28.C06.1.454.CMB.1.raw
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
  modified_base (397)..(397): a, c, t, g, unknown or other
  misc_feature (397)..(397): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctattctggctcccagagatcattggagaagtggtgatgacacagtctccggtcaccctgtcttgtttttccnggggagagagccaccctctcctgtgcggcagtcagagcgttaggacgaacttagcctggtatcagcagaggcctggccaggcctcccagactcctcattcttcggcgtacctttaaacgngggtccaggtacgaactcccagcctaggttcagcggcaggtgggtctgggctttcgtcacgtctcacgtatacaaataccngactaatctacgaccgtatttcgagttagtttatttcgtgtacgtagtctagttcgtagaacgtacgtacggtcccgtttacgtaccggttttcgggaccgggtaacgggtaccgtaggggttaccgaacgttaacgaaacgtacgttacggtcggaccttcggacctaccgtacgttccgttacgttccgtttactaccgtttccccgttccccgtaccttaccgttaccgg

SEQ ID NO: 5968 - DNA, 800 bp, Homo sapiens
  misc_feature: GYAE6OF02GKAA6.8.28.C06.1.454.CMB.1.raw
  modified_base (197)..(197): a, c, t, g, unknown or other
  misc_feature (197)..(197): n is a, c, g, or t
  modified_base (771)..(771): a, c, t, g, unknown or other
  misc_feature (771)..(771): n is a, c, g, or t
tcagctcgcgtgtccacgaccggtgctcgatttagagctcacgtattgggtttggggggaggaactgctcagttaggacccagacggaaccatggaagccccagcgcagcttctcttcctcctgctactctggctcccagagatcattggagaagtggtgatgacacagtctccggtcaccctgtcttgttttccgngggagagagtcacctctcctgtgcggccagtcagagtcggttaggactaacgttacgccgtaggtatcgagcgaaggacggccgtggccacggccctaccccgagtacccttcctactacgtttccgtttcggggaccgttaacccttttaaaccggaccggggtacccgtaagggtacggtaaaccctcccccgaagggtaccccgttaaggggtttcccgaacgggtcccgggtacggttaacggggtttccgggggttaccggtttaccgggggttaacccgttttccgggttttacccctaaccctttccgttaaccctaaaccccgtaacttaaacccgttaaacgttaaaccccgttacgtaaacccgtaacgtttaccgttaccggttaaacccgtttaaccgttttacggtaaccgttttaacgtttttactttcgttacgttacgtacggtacgtacgttacgtaggtaacgtacgtccggttaccgttcgttaccggtttcgggacggggtaacggtaccgtacggtacgaaccgtaacgaacgtaccgtgcgcgtcgcacgtntcgtctacttcgtactcctccgtctgtcg

SEQ ID NO: 5969 - DNA, 773 bp, Homo sapiens
  misc_feature: GYAE6OF02FZMAY.8.28.C06.1.454.CMB.1.raw
  modified_base (195)..(195): a, c, t, g, unknown or other
  misc_feature (195)..(195): n is a, c, g, or t
  modified_base (338)..(338): a, c, t, g, unknown or other
  misc_feature (338)..(338): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtcgcggccagtcaagagcgttaggacgaacttgcctgatcagcagtaggcctggaccaggacctcccagaacctcctcattcgtttacggctacctttaacgaggtccagggtgtaaacncccagccgaggttcgacggtcggacaggtacggggtctacggggtaacctttcgggtttacaaccgtttcctaccgaacctaactttaaccaaaacgtttaaaccctcggactaaaacgttccgtaggtaaccgtttaacccgttttaggcttaaaacgttttttgtttacctacggttaccaaggtaccttaaacgttacgtacggtaaaagacccgttttacggggtaaccctttaccggttaacggttttaccggggaccgggtaaacggggtaacccgttaaaccggggttaccgaaacccgtttaaacgaaaaccgggtacctttacggggaccggttcgtaaccgggtcctaaacccgggttacttaccgttccggtttacctttacctaaaccgtttcccgtttcccccggaaccttcggttaacccg

SEQ ID NO: 5970 - DNA, 750 bp, Homo sapiens
  misc_feature: GYAE6OF02IGL5R.8.28.C06.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (533)..(533): a, c, t, g, unknown or other
  misc_feature (533)..(533): n is a, c, g, or t
  modified_base (585)..(585): a, c, t, g, unknown or other
  misc_feature (585)..(585): n is a, c, g, or t
  modified_base (617)..(617): a, c, t, g, unknown or other
  misc_feature (617)..(617): n is a, c, g, or t
tcagctcgcgtgtccacgaccggtgctcgatttagagctcacgtattgggtttggggaggaactgctcagttaggacccagacggaacagtggaagccccagcgtcagcgttctcttctcctagctactctcggctcccagagatcattggagaagtcgtagactgacacactcgtccggtacaccctggtcttcgtttttccngggggtacaggccgtaccaccgtctccgtgtacggcgacctagtccgagtacggtccgttaagggaacaaacgtttcgccgtaggtactccnggacaggacgccgttggccaacgggtcctacccgacggtaccttccctaacgtactttccgtttacgggtacccgttacccgttttaaacggacgggtacccgtaaggttcggaacctacccgaacggtaccgtaacggtttcgacgggttacccggataacgggttaccggttacgggttcgggtaccgtttcgtttctaaccgttcgtacgaccttaacggtactaacgtaaccncgtactaagtctcggaaaccgttcttagtacgttaacgtttacttcgttacngtaacgcgtatccgtaagtaccgtagtcccgngttcgttacggttcggaacgggtacggtaactaacgggtcgtaaccgtaacgaacggtaacgtcgtaacgggtctacgacccggtaactcttacggttcttacggtactccttacccgtacgtccctagtccg

SEQ ID NO: 5971 - DNA, 916 bp, Homo sapiens
  misc_feature: GYAE6OF02GEOBA.8.28.C06.1.454.CMB.1.raw
  modified_base (206)..(206): a, c, t, g, unknown or other
  misc_feature (206)..(206): n is a, c, g, or t
tcagctcgcgtgtccacgaccggtgctcgatttagagctcacgtattgggtttgggggaggaactgctcagttaggacccagacggaaccatggaagccccagcgcagcttctcttctcctgctactctggctcccagagatcattggagaagtggtgatgacacagtccgtccggtcacccgtgtcttcgtttttccgagggganagacgcccacccgtcctccgtggtcggccggaccgtagtcgaagacggtacggttaaggacgtaacgttagccgtggtaactcgaggcacggacggccgtaggccgtaggccctaccccgaagtacctcccgttataacgtttcgtttcgggaccgttaccgtttaacggacgggtaccgaaggtacggaaactccccggaaggcccgttaacgggttaccacgggtaccggaccgtaagggttcggggttaccgttacggggtaccgttttccggtttacccgtaccgtttaccgtacccaaccgttaacttaaccgtaaaacgttaaccccgtagtaaccttaacgttacccgttaacggaacccgtttaacgttttaccggaccgttttaacgtttttacgtttaccgtcggttaaccgtacgggttaccgtaagtttaccgtaagggtaaaccgttaccgtttacgggttaaccccttacggttaacccggggtttccggggtaacgggtaaaccggggtaaccggtaaacggggtttcccggtaaaaccttaaaccggaaaacccgggttagttcgggttaacccggggtaccttaaccgggttaaacccgtaaccctaaccggtttttaccgacccggtttttacccgttaccgtttaaccccggtttacccccgtaccgtaaccggtttccggtaaacccggg

SEQ ID NO: 5972 - DNA, 700 bp, Homo sapiens
  misc_feature: GYAE6OF02F28SA.8.28.C06.1.454.CMB.1.raw
  modified_base (197)..(197): a, c, t, g, unknown or other
  misc_feature (197)..(197): n is a, c, g, or t
  modified_base (423)..(423): a, c, t, g, unknown or other
  misc_feature (423)..(423): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgcctaccctctcctgtcgccggccagtcaggagtcggttaggacgtaacttacgccgtaggtactcagcaggaggcctggaccaggcctccccgagtacctcctctacttcgtttcggcctaccgtttaacgacggggtccaaggtcggaactcccgagacccgtagggttccaggccggtacgtaggttggggtccgtgggttacctttcgtacncttacctacaccgtattaccaaacttaacctcgtaacctaagtttcgtaccggtacgttacgtttgtactttagttttactttcgtacgtcgacgtactacgttcgtagtaacgtaccgttccgggttaccgttacgttacggtttcgggaccgggtaacgggtaaccgtaaggggtccgtaaccgtaacgtaaacggtacgttaggttacggaccggtcgacctaaccgtagttccgttgttacttctaccgtttcccgtcccgtactcgttaccg

SEQ ID NO: 5973 - DNA, 644 bp, Homo sapiens
  misc_feature: GYAE6OF02FT1LC.8.28.C06.1.454.CMB.1.raw
  modified_base (195)..(195): a, c, t, g, unknown or other
  misc_feature (195)..(195): n is a, c, g, or t
  modified_base (318)..(318): a, c, t, g, unknown or other
  misc_feature (318)..(318): n is a, c, g, or t
  modified_base (407)..(407): a, c, t, g, unknown or other
  misc_feature (407)..(407): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgccggcagtcagagcgttaggacgaacttagccctaggtatcgtagccgaagaggccgtggccaggctcccagactcctcatctttggctcctttaacnggtccagtggaactcccagccgaggttccagcggcgaggtgggtctgggacttcgttcactctacaccatacaataaccctgacaatcngtaacgtctttcgactagttttaagtttctgtacctagtcgtagttcgtcgtaaagtaccttcgggtcccgtttacgtaccggttttccgggacgggtacggggtaaccgtaacggggtacgtaaccgttaccgaaaacgggttactacgggtacggtaccgtacggacctacccgtagttacccgttggttacccttctaaccgttcccgtttaccccgtaccctacttaacccgg

SEQ ID NO: 5974 - DNA, 790 bp, Homo sapiens
  misc_feature: GYAE6OF02GYBTZ.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctttgtttttccgngggacagcgcctaccctctcctggtgcgccagtcaggcgtcgttacggacgtaacttagaccgtgtatcgagcgaggacggccgtcggccacgggcctaccccgagtaccctccgttactagtttccggtttcggacccgttaaccgtttaaccggacgggcctaggttacgggacctaccccgaggtacccgtagggtacgacgggtcggtacgtagggttccgggtacggtcgggtttacctttacggtttaccctacctttaccgtaccgtaaaccctacgtttaacccgaaaaccgttttaacccgcgtaaccgttaacgtttacgtaaccgttaacggtttaaccgttttacgttacgtttaaaggtttttctttaccgtttaacgtcggttacgtaacgttacgttacgttaaacgtacgttaccgtaccggttacccgttaccgtaccgggtttaccgggaacgggttacgtacccggagggtaaccgtaaccgtaacgaacgttcgttaggacggttaccgtaacgtcctaccggtacttcgttacctacgtttaccaccgttcccgtccctagttccgtaccgg

SEQ ID NO: 5975 - DNA, 841 bp, Homo sapiens
  misc_feature: GYAE6OF02JCZ5T.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtgggggagagtacgccaccctctcctggtgccggccagtcagacgtcggttaggaacgtaacttaggcctagggtactcgtaggcaggacggcctggacccaggcctcccgagaccttcctctagttccgtttacgggtcctaccctttaaacgacggggtcctaggtacggaaccttcccgacgtacccgtaacgggtttccaaggtccggggctacgggttacggggtacgttaacgggtaccgttttccgggttacctaccttccgttacccaacccgttaactaacccgttaaaacttaaccccgttgggtaaccttaaaccgtttccgttaaccgggtaaccggtttacccgtttttacggtaacccgttttaagggttttttaaccttttacccggtcgtttaactaacgggttacgtttacgttacggttacgtaaaacgggtccggtttaccgggttacccgtttacgttaaccggttttaccggggggaccgggtaacgggggtaacccgttaacggggttaacgtaaccccgtaaacgtaaaaccggtacgttcgggtacggtacgttaccgcgtaacctcgtttcctacggttaccctttactacccgtttccctccccgtacctattaccggg

SEQ ID NO: 5976 - DNA, 788 bp, Homo sapiens
  misc_feature: GYAE6OF02GG5UW.8.28.C06.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttccngggganagacgccaccctntcctgtcgcgccagtcagagtcgttaggacgtaacttgcctaggtactcagcagaggccgtggccaggcctccgagaccgtcctctacttcgttggccgtaccgtttaacgacgggtccaggtcggtaactcccgacgccgacggttcaggtcggacgacggttcggggtccgttaggggtccctttcggtttaccaccgttccgtaccaacccgttaataacccgtaaaacgtaacccttacggtaacctaaacgttacgtacggtaaacccgttaccgttttaggaccgtttaacgtttttaactttaccgttagttaccgtaacggtctaacggttacctacgggtaaacgttaacgtccgggtacccggttttaacgttaccggtttccgggggtaccggggttaacggggtaacccggttaaacggggttaccggtaacccgttaaaccgggtaaaccgtaaccggttacggtacggggtaccgtacggtaaccctaacccggtacttaccggttacgttaccgtttacgttacccgttacccgttaccccgccgttaccttaacccgg

SEQ ID NO: 5977 - DNA, 711 bp, Homo sapiens
  misc_feature: GYAE6OF02FVDN1.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgccggccagtcagagcgttaggacgtaacttagcctggtatcagcagaggcctggccaggcctcccagacctccgtcatcgtttggccgtcctttaacgagggcccaggtacggaactcccgagcccgtaggttacaggtccggctaggtcgggtctcggggtacttacggttcaaccgttcctaccaccgattacaaacttaacctgacctaattcgtacggtaccgtacgttttgaccttaggttttactttacgttcggtactacgtaccgtagtttccgtaggaacgttaccgtcgggttacccgtttacgtaaccggttttcgggacggggtaacgggtaacccgttaaggggtccggtaaccctaaccggtaaaccgtacgttcgggtacggtaccggttaacggccctaaacctccggttaccttaggttacccttttacccgtaaccgtttccccggtttacccccgtccggtaacctttccgg

SEQ ID NO: 5978 - DNA, 720 bp, Homo sapiens
  misc_feature: GYAE6OF02J21TJ.8.28.C06.1.454.CMB.1.raw
  modified_base (159)..(159): a, c, t, g, unknown or other
  misc_feature (159)..(159): n is a, c, g, or t
  modified_base (194)..(194): a, c, t, g, unknown or other
  misc_feature (194)..(194): n is a, c, g, or t
  modified_base (484)..(484): a, c, t, g, unknown or other
  misc_feature (484)..(484): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtnatgacacagtctccggtcaccctgtctgttttccnggggagagagcccaccctctcctggtcgcggccagtcagacgtcgttaggaccgaaactttggccttgggtactcgaaggcaggacgcccgtaggcccaggccctaccagtcctcccgtcagtttccgttggtaccttaccgttaacgacgggccgtagggtcggtaaccctcccggacgtaccggtacgggttaccacgggccgtaggtacggtttccggggtcgttaaccggggtccgttttcctacgtacctcccgttacaacgtactaaccaaacgttacccgtanaccgtaactcgtacgtaaccgttcgttacgtcgttaacgtttacttcgtacgtacgtacgtacgtcgtacgtagaacggtacgttcgggtaccgttaacgttacttacgggacggtacggtaacggtacggtaccgtaaccgtaacgaacgtaccggtagtcggtaccgtaacgtccgtaaacctgttacgttcgttacctacgttcccttacccggtccgtacgtacttacccgg

SEQ ID NO: 5979 - DNA, 825 bp, Homo sapiens
  misc_feature: GYAE6OF02F0AX4.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctcggtcaccctgtctgtttttccgtggggagagacgccaccctctcctgtgcggccagtcagagcgttaggacgtaacttagccgtggtatcgagcaggaggcctggcccaggcctacccgagacctcctactattcgtttggccttacctttaaacgcgggtacctaggtcggaaactccccgaagtcccgtaggttaccacgggccggtacgtaacggttggggtccgttaggggtaaccttttccgggttacaccgttccgtacccgtaacctaacgttaaccctaaaacgtttaaaccccgtaggaccttaaacgtttaccgtaacgtaaccgttaacgtttttacggaacgttttaagtttttaactttccgttaaggttaccgtacggtaacgttacggttaccgttaggaaacggttaccgttcgggttaacccgttttccggttaaccggttttaccggggacccgggggttaaacgggtaacccgggttaaacggggttaacccggtaaacccggttaaaccgaaaaccgggttaaccgttaggggtaccggtaccgtaccggaccctaaccgtacgttaccgtttaccgttaccgtttaccgtaacccgtttaccccgttaccccgtaaccgttagttaacccgg

SEQ ID NO: 5980 - DNA, 701 bp, Homo sapiens
  misc_feature: GYAE6OF02I0CQ3.8.28.C06.1.454.CMB.1.raw
  modified_base (372)..(372): a, c, t, g, unknown or other
  misc_feature (372)..(372): n is a, c, g, or t
tcagctcgcgtgtccacgaccggtgctcgatttagagctcacgtattgggtttggggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggcagtcagagcgttaggacgaacttagcctggtatcagcaggacggcctgggacccaggcctacccgagacctccctctacttcgtttcggccgtaccgtttaacgacggggccaggtaggaactcccagccgtaggttacaggcggngtaggtcgggtcgtagggtaccttcggttaccactcctacctaacctaactacctaaacttaccgtacgtactaactctacggtaaccggttactttaggtactttagtttttaactttcctagttaccgtagtactacggttactaggtaacgtacggtacggttaccgtttaccgttaccggtttccggggaaccgggtacggggaaccgtaaagggttccggtaaccgtaaaccgaaacgtacgtcggtacggacctcggtaccaaccgtacgttccgttaccgttacttccgtaccgttcccgtacccgtaccttacgttaccgg

SEQ ID NO: 5981 - DNA, 778 bp, Homo sapiens
  misc_feature: GYAE6OF02G9LQN.8.28.C06.1.454.CMB.1.raw
  modified_base (234)..(234): a, c, t, g, unknown or other
  misc_feature (234)..(234): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccgtggggagagagcccaccctctcctgtgcggccagtcagngtcgttaggaacgtaacttagccgtggtatcagcaggacggccgtcggccagggcctccccgagtaccttcctctacgttcgtttcggccttaccgtttaaccggcggggtacctaggttacggaacttccccgaaggtcccgttaagggttccgacggtccgggcgtacgggttcggggttcggttacgggttacctttccggtttaccgtaccttcctaccaaccgtacttaaccgaaaacttaacccgtagtaacctaacgttccgtacggtaaccgttaccgttttacgtaccgtttagtttttactttccgttcgttacgacgtacgtacgttacgtaggtaacgttacgtaccgggttaccgttaccgttaccggtttaccgggggacgggttaaaccgggtaccggtaaccggggttccggtaaaccgtaaaccggaaaccggtacgtcgggtacggtacgttaccgtaccgtacctacggttaccgtttccgttacgttcccgttaaccgtttcccgtacccctccttaagtcccg

SEQ ID NO: 5982 - DNA, 997 bp, Homo sapiens
  misc_feature: GYAE6OF02FQSVB.8.28.C06.1.454.CMB.1.raw
  modified_base (207)..(207): a, c, t, g, unknown or other
  misc_feature (207)..(207): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcagttggagaagtggtgatgacacagtctccggtccaccctgtcttgtttttccgggggagagcnccaccctctcctgtcgccggccagtcagaggtcgttaggactaattagccgttggtatcagcgaggacggtcccgtgggaccacgggtccctaccccgtacgtaaccgttccctctaacgtttcccggttttcggggccccgttaaccgttttaaccgggaaccgggcccgtaggggttaccgggtaaaccttcccccgaaggttaccccggtaagggtttcccgagggtccgggtacggtacgggtttcggggtaccgttcgggggttacctttttccggggttaccctaaccgttccgtaccgtaaaccctaacgttaaccgaaaacccgtttaacctttaccggaaccttaaacgtttacccgtaccgggtttaaaccgtttaaccggtttttcggttaacccttttaaggtttttttaccgttttacggttaccggtttaacggtaccggtttccgtaaacggttttccggtttaaagggaaccgtttacgggttacccggggtttcccgttttaaccgggttttacccgggttttaccggggggaacccggggttaaccgggggttaaaccccgggttaacggggttaacccgggtaacccggttttaaaccgaaaaacccgggttttaaccgggtttcgggttaacccgggtacccgtttaccggggaaaccccctttaacccgggttgtttaacccccggttttacgggttttaaccccttttaccgttaacccccggttttccccttttaccccccgggtaactttacccccgggtttcggg

SEQ ID NO: 5983 - DNA, 700 bp, Homo sapiens
  misc_feature: GYAE6OF02H9M5J.8.28.C06.1.454.CMB.1.raw
  modified_base (165)..(165): a, c, t, g, unknown or other
  misc_feature (165)..(165): n is a, c, g, or t
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (296)..(296): a, c, t, g, unknown or other
  misc_feature (296)..(296): n is a, c, g, or t
  modified_base (441)..(441): a, c, t, g, unknown or other
  misc_feature (441)..(441): n is a, c, g, or t
tcagctcgcgtgtccacgaccggtgctcgatttagagctcacgtattgggtttgggggaggaactgctcagttaggacccagacggaaccatggaagccccagcgcagcttctcttctcctgctactctggctccagtagatcattggagaagtggtgatgacangtctccggtcacctgtcttgttttcngggganagacgcctacctcncctgtacgcgtccagtcgagngtcgtacggacgtacttacggctaggtctacngngagacggctcggccaggcctccgagcctcncattccgttgaccttaccgttaagacggtccaggttacggacctaccgacgtccgtaggttccgaagccggtgtaacgggtcggggtactagggtacctttcgtacctaccgttctaccccaaactttacgaaccaacgttaacncggtaaccactaccgtacgtaaccgttactttacgggtacttacgttttacgttctttcgccgttagtcgttacttacgtagttacgtacggtccttacccggttacgtttaccggtcggggtaccggaaggttaaccggtaccggtacggtaaacctaaccgtaacgtaccgttacgggaggtccggtaccaccggtacctacgtttcgtccgttacttaccgttccggttaccccttaccccggtctaaccgttcgg

SEQ ID NO: 5984 - DNA, 853 bp, Homo sapiens
  misc_feature: GYAE6OF02GHFYR.8.28.C06.1.454.CMB.1.raw
  modified_base (140)..(140): a, c, t, g, unknown or other
  misc_feature (140)..(140): n is a, c, g, or t
  modified_base (591)..(591): a, c, t, g, unknown or other
  misc_feature (591)..(591): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagngatcaattggagaagtggtgatgacacagtctccggtcaccctgtcttgttttcctggggagagcgccaccctctcctggtcggcgggcctaggtccagacgtcggttaacggaacgtaacctttaaggcccttgggtactacgtaaggcctaaggacggtccgtcggacccggagggacccttacccggaacggtaaccctcccttaccgtaactttacccgttttacggggacccgtaccgtttttaaaccgacggggtacccgtaaggttcgggtaaaactccccgtaacgtccggtaacgggttaccaaggtccggggacgttacggtacggggttccgttaggggtacccgtttacgttaccctaccggtacccttccgaaccgttaacctcctaaaacttaaccgttccgactaacgttcgtacgtaccggttacttttaccggnttaaccggttttagtttcccgttacgggtctacggtacgtaaccgttcgttaaggtaacgtaaccggtcggtttacccgggtttcctaaccgggttttacggggccgggtaaacggggtaccggtttaaaggggtcggaacccgttaaggaaacccggttacgtaccggttgggtacgtccggtaacccgtacccgtaatttacccggtagtttccctttacgtacccgtttacccctccgggtaacccttgttaaccccgg

SEQ ID NO: 5985 - DNA, 730 bp, Homo sapiens
  misc_feature: GYAE6OF02IOB23.8.28.C06.1.454.CMB.1.raw
  modified_base (199)..(199): a, c, t, g, unknown or other
  misc_feature (199)..(199): n is a, c, g, or t
  modified_base (397)..(397): a, c, t, g, unknown or other
  misc_feature (397)..(397): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctccagagatcattggagaagtggtgatgacacagtctccggtcacccgtgttcttgttttccgnggggacagcgccctaccctctcctggtcggccgacagtcaggtacgtacggttacggaccgtaacttacgccgtaggtactcgaggtacgtaaggacgtccgtacggaccaggtcccctaccgagtcctcctacgtacgttcgttacggaccgttaccttaaggcggtactaggtacgtactccgagtcgtaggtacnggcgtagtaggttcggtccgttagggtacctttcggtactccgttaccgactaactactaacgtaaacttacgcgtaactacgtactacggtaacgttcgtttacgacgtttacgtttacgttaccgttacgtacgagtacgtaaccgtcggtaagtaccggtaccgtaccgggttcttaaccggttacgggttacgggaacggggtaacgttaaccgggtaaggttaaccggtaccctaaaggtaacccgtaggtacggttaccgtagaccgtaaccgtacgtaacttcggtacgttacgttaccgtaccttcccgtactaccgtataccgg

SEQ ID NO: 5986 - DNA, 757 bp, Homo sapiens
  misc_feature: GYAE6OF02F4XB2.8.28.C06.1.454.CMB.1.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtagatgacacagtcctccggtcaccctgtcttgtttttccgnggggagagacgccctaccctctcctgtgccgccagtcagagtcgtaggacgtaacttcgcctgtatcgagcgagacgccgtggaccgtacggcctcccgagacctcctactacttcgttcggaccttaccgttaacgacgggtacaacgtggaacctcccgagtaccgtacggttccgacggtccggacgtacgggttcgggtccggttacgggtacccttttaccggtaccgtaccgttcccgtaaccctaacccgtagttaaccctaaacttacccgtagtaaccctaacgttaccgtaaccggtaacgtttaccgttttacgaccgttttaagttttacgttccgttacgtactacggtacgtacgttaccgtaagtaacgttaccggttacggttacccgttacgttaaccggtttcggggaccgggtaacggtaaccggtacgggttacgtaacccgtaaaccgaaaccgtcgttacggacggtacgttcgaaccgtacgtacttccggtaacgttccctacgttaccgttacccgtccctacgtacttaccgg

SEQ ID NO: 5987 - DNA, 834 bp, Homo sapiens
  misc_feature: GYAE6OF02GKL8K.8.28.C06.1.454.CMB.1.raw
  modified_base (113)..(113): a, c, t, g, unknown or other
  misc_feature (113)..(113): n is a, c, g, or t
  modified_base (128)..(128): a, c, t, g, unknown or other
  misc_feature (128)..(128): n is a, c, g, or t
  modified_base (142)..(142): a, c, t, g, unknown or other
  misc_feature (142)..(142): n is a, c, g, or t
  modified_base (200)..(200): a, c, t, g, unknown or other
  misc_feature (200)..(200): n is a, c, g, or t
  modified_base (755)..(755): a, c, t, g, unknown or other
  misc_feature (755)..(755): n is a, c, g, or t
  modified_base (828)..(828): a, c, t, g, unknown or other
  misc_feature (828)..(828): n is a, c, g, or t
tcagctcgcgtgtccacgaccggtgctcgatttagagctcacgtattgggtttgggggaggaactgctcagttaggacccagacggaaccatggaagccccagcgcagcttcncttcctcctgctacnctggcctccagagntcattggagaagtggtgatgacactgtctccggtcacccgtgtcttggtttttcccgnggggactacggacgcccgtacccttcgtcctggtcggccggactagtcgaaggcgttaccggttagggaactaacgttacgtcccgtaggtactacgacgtacgtacggaacggtccttggaccccgtaagggtccctaccacgtaccggttcctaacgtctttaccgtttcggacccgttaccgttaaaccggcgggtacccgtaggttaaccggtaacctaccccgaacgggttaacccctaggggttaccgaacggtccgggtactaccgggtttgggttaaccggtcggggtttaacctttccgggtttaacccaacgggttttccacccgttaaccggtaacttacccgggtaaaatttacccggcgtaaaccgtacgttaccgtaacggtaccgttaacgtttaccgtacgttacgtttacgtttaccgagttaccgagttacgtacgtttaacacgggaactttaacggccgtttccgtaaccgttaccggttcggtaccgggaacgggtaccctaaggggtacccgtaacggtaacctaaaccgggntttacgggcgtacgtacggactaaccggtctaacgttcgtaacttcgtacctacccgtttacccggactttanacccgg

SEQ ID NO: 5988 - DNA, 576 bp, Homo sapiens
  misc_feature: GYAE6OF02GD4Q5.8.28.C06.1.454.CMB.1.raw
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtccttaacgnggccagngaactcccagccaggttcagcgcagtggtctgggacttcgttcactctacaccatcaataaccctgactaactctacgtacgtatttcgctaagttttactttcgtgtcagtctagttcgtgaacgtactggtcccgttcgtacgtttcggacgggaacggaccgtaagggtcgacctacgaaaccgtacgtcgtggccgtcggaccgtaacctagttccttgttccttacgtacttccgtttaccccgctacgtccg

SEQ ID NO: 5989 - DNA, 766 bp, Homo sapiens
  misc_feature: GYAE6OF02HSISG.8.28.C06.1.454.CMB.1.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (510)..(510): a, c, t, g, unknown or other
  misc_feature (510)..(510): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggcctccgagagatcagttggaagaagtggtgatgacacagtctccggtcacctgtcttgttttccgnggggganagacgccctacctctccgtggtacgccggcctaggtcaggacggtacggttaacggaccgtaaacgttcggccgttagggttaactcgaacgtcgaaggcggtccgtggccgtacggcctcccgaagtcctccgtctacgttcgtttcggaccgttaccgttaacggacggtccaggtacggtaacctccgacggaccgttacggttacgagggccgtacgacgggttcggtacgtcgggtactttcgtacaccgttacctacaactcgtaaactaaccgtactgactaactcgtacgtaacgttnttacggtactttaacgtttcttcttacggtacgtacgttacgttacgtacgtaacggtacgttaccggtaccggttcgttaccggttaccggttaccggggtaccgggtaaacggtaacccgagggttaacccggtaaccgtaaacgttaaaacgggttccgtacgggtaccggtaccgtaacgtacccgtaccggttaccttccggttacgttaccttacgtaacccgtttccctacccgtacggttactaccgg

SEQ ID NO: 5990 - DNA, 891 bp, Homo sapiens
  misc_feature: GYAE6OF02HNOOV.8.28.C06.1.454.CMB.1.raw
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctccagagatcattggagaagtggtgatgacacagtctccggtccacccgtgtcttcgtttttccgnggggtagagtacgccctaacctcgtccgtggttcgccggctacgtcgagagtcggttacggacgtaacttacggccttagggtctcgacgtacgaaggacggccttcgggaccacgggtcctacccaacgtacgtcccgtagtacttcgttttagaccggtaccgttttaacggacggtccctaaggtacggaacccttcccaacggacgttaccggttacgaacgggtccggtccggtaagggttcggggtaccgttacggggttaccgtttacccggttgtaaccgttaccgttccaaacccggttactaaaccccgggtttaaacaaaccccgtttaggaacccgtttaaatacccggttaacggtaacccggttaacccgttttacgaaccgttttaacggtttttacctttaacccgtttggtacccttaagggaacccgtttacggtaaccgttttacggaaaccgggttaaccgttccgggttaccccgtttaaacccgtttacccgggtttacgggggtaaccgggggtaacccggggtaacgtttaacggggtaccggttaacccggttaaaacgaacccggttaacggttcgggtaccgttacggtccggtaccgtacgtaaccgtttccgtgttaccttaccgttaacgttcccgttaacccggtccttaagttacccgg

SEQ ID NO: 5991 - DNA, 607 bp, Homo sapiens
  misc_feature: GYAE6OF02FSE4D.8.28.C06.1.454.CMB.1.raw
  modified_base (195)..(195): a, c, t, g, unknown or other
  misc_feature (195)..(195): n is a, c, g, or t
  modified_base (266)..(266): a, c, t, g, unknown or other
  misc_feature (266)..(266): n is a, c, g, or t
  modified_base (410)..(410): a, c, t, g, unknown or other
  misc_feature (410)..(410): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggggagagagccaccctctcctgtgcggccagtcagagcgttaggacgaacttagcctggtatcagcagnggcctggccaggcctcccagacctcctcatctttggcgtcctttaacgacgggccagtggaactcccagcctaggttcaggtcggcaggtgggtctggggacttcggttcacgtctcacctatcaaataacctgacaactctanacgtactttgctagtttattctgtacagactagtctagaacgtcgtcggtccgtttactacgtttcgggcgggtacgggacctaagggtcgtacccgtagaaaccgaacgttcggacggtcctaggaccctaaccgacgttaccgttacgtttacttaccgtacctttacccgttccccgtacccctaattacccgg

SEQ ID NO: 5992 - DNA, 628 bp, Homo sapiens
  misc_feature: GYAE6OF02FO09S.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagagcgttaggacgaacttagcccgtggtactcagcagaggccctgggccaggcctcccagacctcctcattctttcggctccctttaacgacgggtaccaggtaggaactcccgagccaggttcaggcggcaggtgggtactggggtactttcggtcactctcaacctatacaaataacctgacaatcgagacgtatttcgcttagtttacttcttagtcctagtctaggtcctagtaacgtccgtacggtccttacgtaccggtttaccggacggggtaacggaacccgtaaggggttcgaacccgtaacgaaacggtaccgtgtacggtcgttaggaccgtaacctacgtaccgtgttaccttaccgtactttcccgtaccccgtctacgttccg

SEQ ID NO: 5993 - DNA, 734 bp, Homo sapiens
  misc_feature: GYAE6OF02I80Z6.8.28.C06.1.454.CMB.1.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacactagtctccggtccaccctgtcttgttttccgngggganagacgcccacccttctccgtgtcggccggaccagtcagagtcggtagacgtaacttgccgtggtactcgagcgaggacggcctggaccaggccctacccgagtaccctccgtactacgtttcggtttcgggacccttaccgtttaacggccggggtaccaggtacggaacctcccgagtcccgtaggtacgacggtccgggactacgggtcgggtacgtacgggttacctttcggttacaccgttcaccgtaacctataccgtaaacgtacccgtgacctaactccgtaacgtacgttacgtttcgtacgtttagttttactttcgtacgtactacgttacgtacgtactacgttaacgtaccggttcgttaccgttcttaacgggttccgggaacgggtacggtaaccgtagggtacccgtaacgtaacgtaacgtaccggtagtcggtaccgtcggtaaccctacggtacttccggttacttcccgttaccgttaaccgtccccgtttacccggacttacgttccgg

SEQ ID NO: 5994 - DNA, 821 bp, Homo sapiens
  misc_feature: GYAE6OF02JLPT2.8.28.C06.1.454.CMB.1.raw
  modified_base (208)..(208): a, c, t, g, unknown or other
  misc_feature (208)..(208): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctccagagatcattggagaagtggtgatgacacagtctccggtactaccctgtcttgtttttccgaggggagagacncccacccttgttccttaggtcggccggtacctaggtccaggacgtccggtttaaggaaccgttaaaccgttgtcccggttaggtacctacgtaagccgacggtaacggtcccgttgggaccccgtagggacccttcccgaacggtacccttactactacgttcgttttacggccggttaaccttaacgtacggggacctaggtaggtaaccctccggacgttccgtaacggttcgagggtccggaacgttacgggtgggtccgtttacggtcgtttacgtttccgagttccttacgaacctacgttaaaccgactttaaaccggtgtaaccgttacgtccgttaacgggtaccgtacggtttttaccgacgttttaacggttttactttaccggtcgttaacggttacgtaacgtacgttaccgtaagggttaacttcccggtccggtttacttccgtaccggggtttccgggaacgggtaacggtaccgtaaacggtaccgtacgtaaacggttaccgagttcgggaccgtttcgacccgaacctcgttaccggttacttggttttaaccccgttacgtcccgtttacccttaccccggtacttaggtccgg

SEQ ID NO: 5995 - DNA, 871 bp, Homo sapiens
  misc_feature: GYAE6OF02GZLGY.8.28.C06.1.454.CMB.1.raw
  modified_base (143)..(143): a, c, t, g, unknown or other
  misc_feature (143)..(143): n is a, c, g, or t
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagntcagttggagaagtggtgatgacacgtagtcgtccggtcaccctgtcttcgtttttccgngggganacgagccccgtaccctctccgtgtcgccggaccagtcagcgtacggttaacggacgtaacgttcgccgtaggtatccgagcgaaggtacggtcccgttgggacccgaacggtacccgttccccgaaggtacccttacccgtacgttaacgttttcccggtttcgggaccccgtttacccggttttaaaaccgggacggggttaccccctaaaggggttaccggtaaaccccgtttacccccgaacgggttcccccgttaaggggttttacccgaaaccgggccgggttaacccgtagggtttaccgggggttcgttacgggggtttaacccgttttccgggttaaccctaaccggtttcccctaccgtaaacccgttaacgttaaacctaaaccggtttaaccctacggttaacctaaccgttaccgtttaccggtaacgtttacgttttacgtactttaaggtttttacttcggttaacgtcgaacttcggtacgtactaacgtacgtacggtccggttccttaccggttaacgtttccggggacggtaacggtacgtacgggtacgtaccgaacgtaacgtacgttacgacggtcgccgaaccgtacgtcgttcgttaccgttcgttacctaccgttccgtacccgcgttacttaaccgg

SEQ ID NO: 5996 - DNA, 730 bp, Homo sapiens
  misc_feature: GYAE6OF02FFV1G.8.28.C06.1.454.CMB.1.raw
  modified_base (207)..(207): a, c, t, g, unknown or other
  misc_feature (207)..(207): n is a, c, g, or t
  modified_base (552)..(552): a, c, t, g, unknown or other
  misc_feature (552)..(552): n is a, c, g, or t
tcagctcgcgtgtccacgaccggtgctcgatttagagctcacgtattgggtttgggggaggaactgctcagttaggacccagagggaaccatggaagccccagctcagcttctcttcctcctgctactctggcctcccagactaccacggagagattgtgttcgacacagtctccacgccaccctgtctttgtctccgaggggaaancgcccacctctcctgccgacgggccagtcagtacgttacgtacccaccgtagttacgaccgttacggtaaccaaaccaccgtaaaaccgtcggacccgagggtccctaccccgacgggtccccctactacttcgttttacgacgtcgacctaactcccgtaactccggaaccggcctaccggtcggaccaccgtaccccgacggtacccgtagggttaccgtaggtcgggtacgtgggttacggggtccggtacgggaaccgtacgttaccttaccgtactcctacccgtaacactcgtaacgacgaccgtacccgtaagggaccctacgtaagtaaacggtttntttacggtactttaacgttaacttacgtcgtaacaacggttacgttaccgacgggttcgtaccgggtacccgggttccgggaccttccggttaccggaccgtacgtaaacgtaacgtgacgtacgtataccgagtcgacgtctacactctagttctcgtctacctcgttcctaccgac

SEQ ID NO: 5997 - DNA, 819 bp, Homo sapiens
  misc_feature: GYAE6OF02FXCRQ.8.28.C06.1.454.CMB.1.raw
tcagctcgcgtgtccacgaccggtgctcgatttagagctcacgtattggggtttgggggaggaactgctccagttaggacccagacggaaccatggaagccccagcgcagcttctcttcctcctgactactctaggcctacccgagagatcaagttggagtaacggtggtgatgtaacactagttcgtaccggtcacccgtgtctttcgttttccgtaggggagacgacgtcccgtacctctccgtgtcggccggaccgtacgtcgaagtacggtcgttaacggacgtaacgttagacccgtaggttactccgaagtcgacggtacgacccgtgaccgtacggtccctacgaacgtaccttacccttagtaccgttttccgttacgggtaccctttaacccggtttaaacggaaccgggggtcctaagggggttaacgtaacccgtaccccgtaacggtcccgtaaacggtttacgaccggaaccggttacggttaacgggttcggggttaaccgttaccggggttaccttttaaccggttacgttaaccttcggtaaaccccaacttcgttaacctaaacgtaccgtagactacgtacgtacgtactccgttagtaacgttaatttctctagactacgactattacgtacgtacgacggttccgtacgtttacgtccgttaggggacctaacgggacgtaacggtacggtaaacctaaccggaaacgttcggtacgtcgaccggttacgaccggtaacttacgttacgttccgtaccgtttaccgtacgtttaccccgtccggaccttcggtaaccgg

SEQ ID NO: 5998 - DNA, 790 bp, Homo sapiens
  misc_feature: GYAE6OF02G86IK.8.28.C06.1.454.CMB.1.raw
  modified_base (196)..(196): a, c, t, g, unknown or other
  misc_feature (196)..(196): n is a, c, g, or t
  modified_base (237)..(237): a, c, t, g, unknown or other
  misc_feature (237)..(237): n is a, c, g, or t
  modified_base (499)..(499): a, c, t, g, unknown or other
  misc_feature (499)..(499): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtcttgtttttccgnggggagagacgcccaccctctcctgtcgcggccagtcaggngcgttagacgacttagcctggtactcagcagacggcctggccaggcctacccgagtacctccctactacttcgtttcgggccgttaccgttttaaaccgacggggaccctaaggttcgggaaacctccccgaacggtaccccgtaagggtttccgaacgggtccgggacgttagggttccggggttaccgtcgggggttaccttttccgggttaccgtaccttcctaccgtaaccctaattacccaaaacgttaacccgtanaaccgtaactccgtacggtaaccgttaccgtttaggtacctttaacgttttaactttcgttacgtacgacggttacgtaacggttactaggtaaacgttccgtacgggttacccgtttacgttaccggtttcgggacggggtaacgggtaaccggtaaggggttaccggtaacccgtaacggtaaaccgtacggttacggtcggtacccgtacggtaacctaaccggtaacttccggtttacgttcccgttaccttaccgtttaccccgttaccccgtacttaccgtaccg

SEQ ID NO: 5999 - DNA, 910 bp, Homo sapiens
  misc_feature: GYAE6OF02F0A3L.8.28.C06.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtcctcggtcaccctgtcttgtttttccgnggggagagacgcccaccctctcctggtgccggccagtcgagagtcggtaacggaacgtaacttagccgttaggtatcgaggcaaggacggtccgtgggaccacgggtccctaccccgaagtacccttacccgttactaacgtttccgtttcgggacccgttacccgttttaaaaccgggagggtaccctaagggttacgggtaaaccttcccccgaaggtacccggtaacgggtttaccgacggggtaccgggtacgtaaggggtttccgggggtacggtttacggggttaacccgttttaccggtttacccgtaaccgttcccgttaaccctaaaccctaagtttaacccgtaaaaaccgtttaacccgtacggtaaacctttaaaacgtccgtttaaaccgggtaaaccgttttaccgttttaaggtaaccgttttaaacgtttttttacgtttaccgtacggtttacctaggtacccgttacggttaacgtaaacgggtaacgtaacccggtttccgggtaaccgtttttaccgacccggggtttaccggggaacgggtaaccggggtaacggttaaaccggggtcggaaaccctttaacggaaaccgttaaggttccgggtagtacccggtagtaaccccgttacctagttccgtttacggttacccttcgtaacctttccccggtacccgtaacccgttgttaaccgg

SEQ ID NO: 6000 - DNA, 764 bp, Homo sapiens
  misc_feature: GYAE6OF02I6LA2.8.28.C06.1.454.CMB.1.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagacgccaccctctcctgtgcggccattcagagtcgttaggacgtaacttagccgtggtatcagcagagcctggccgaggcctcccgacgtacctcctctacttcttcggccgttaccgtttaacgacggggcctaggtacgggtaactccccgagcccgtaacgggtttacgacggccgggtccgtaacgggttcggggtccggttacggggttaccgtttccggtttcaccttactaccaaccctaacgttacctaaaacttaaccgttacgacctaacttccgttaacggtaccgttaacgttttcgttacgtttaacgtttttacgtttacgttagttacgtacggtacctaggtttacgtacgtaaaccggttaccgttcgggttcccgtttaccggttaaccgttttaccggggacccgggtaacggggtaaccgtaaccgggttaccggtaaaccggtaccgtaaaacgggtaacgtggttacgccgtacggacctaaccgttagttccgtttacgttcttacgtaactttcccgtttaccggtaccttgtaccgg

SEQ ID NO: 6001 - DNA, 774 bp, Homo sapiens
  misc_feature: GYAE6OF02IO2MF.8.28.C06.1.454.CMB.1.raw
  modified_base (143)..(143): a, c, t, g, unknown or other
  misc_feature (143)..(143): n is a, c, g, or t
  modified_base (169)..(169): a, c, t, g, unknown or other
  misc_feature (169)..(169): n is a, c, g, or t
  modified_base (205)..(205): a, c, t, g, unknown or other
  misc_feature (205)..(205): n is a, c, g, or t
  modified_base (624)..(624): a, c, t, g, unknown or other
  misc_feature (624)..(624): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagntcattggagaacgtggtgatcgacanacgtctccggtaccaccctgttctttagttttccgnggggtagagtacgccctacccgttcctccttggtcgccggcccagttccaaggtacgtacgttaacggaccgtaacgtttcgccgttggtactccgaggtaccaggtacggcctacgggccgtacggcccttacccgagtacccttacctccgtaattttccgttcggggtacccttaccgtttaaacggacggggtaccctaaagggtaccggtaaacctccccggtaacgtcccggtaacgggttaccacgggaccggtacggttacgggtttcggggtacggtcgggtttaacctttccggttacgtaacccttcggtaaccctaaccgtacgtaacctaacgtaaccgtgtactaacgtcggttaactaaccggttctttaacggtagtttacttttacgttacgtacgtacgtntaacgtccgtagtacgcgttacgccgttactcgtacgtcggacggtaggtaccgtaggacctaccgtaacgaacgttcgtgtacgctaaccggctaacgttacgtccgtttagtccttacgtaccgttccccgaacgtacgtctaaccgg

SEQ ID NO: 6002 - DNA, 816 bp, Homo sapiens
  misc_feature: GYAE6OF02IJRM7.8.28.C06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagagctcacgtattggggtttggggaggaactgctcagttaggacccagacggaaccatggaagccccagcgcagcttctcttcctcctgctactctggcctccagagatcattggagaagtggtgatgacacagtctccggtcaccctgtcttgttttccgnggggagagacgccctacccgtcttccgtggtcggccggaccctagtcgaaggacgtcgggttaacggaaccggtaacttacgcggttaggtactacgaagcgaacgggacggtcccgtgggcccgaccgggtaccctccccgaacggtaccttaccctcttacgtttccggtttcggaccggttaacccgttttaaacggccgggtaccgtaaggtacggtaaccgtcccgaacggtcccgttaacggttccgacgggtccggtcggtacgggtttcgggtcggttacggggttaccgtttccggtttcgtaacttcccgtacctaaccgtaacctaacctaaacgttacccgtacgtaacgttaacttcggtttaacggtaacgtttaacgtttcggttaccgtttaacggtttttcttaccgtttggtaccgaacttcggttacgtacgttacgaacgtcggtacgtttccgttaacgttcggggtttaccgggaacgggtaaccgggtaacggtacggtaccggtaaccctaacgtaaacgtacgtcggacggtccgtaacgacccttactcgttccttacgttctaccgtttcgttcccctacccgtacctaggtc

SEQ ID NO: 6003 - DNA, 255 bp, Homo sapiens
  misc_feature: GYAE6OF02FJUPA.8.28.C06.1.454.CMB.1.raw
  modified_base (196)..(196): a, c, t, g, unknown or other
  misc_feature (196)..(196): n is a, c, g, or t
  modified_base (220)..(255): a, c, t, g, unknown or other
  misc_feature (220)..(255): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggcctccagagatcattggagaagtggtgatgcacagtctcggtcaccctgtcttgtttttccgnggggagagagccacccttcgtctnnnnnnnnnnnnnnnnnnnnnnnnnnnnnnnnnnnn

SEQ ID NO: 6004 - DNA, 816 bp, Homo sapiens
  misc_feature: GYAE6OF02GAY5C.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagattattggagaagtggtgatgacacagtctccggtcaccctgtcttgtttttccgtggggagagacgcccaccctctcctgtcgcggccagtcagagtcgttaggacgtaacttacgccttggtatcagcaggacggccgtggccacggcctcccagacctcctcattccgtttggccgtacccgtttaagacgggtcccgaggtacggaactccccgagtcccgtaggttcacggcggtacgacgggtcgggttacgtacgggggtacctttccggttacctacttaccgttccaaacctacgttaacctaaaacgttaaccctcggtaaccaacgtttccgtacggtaaccgtttacgttttacgtaccgttttaacgtttttacgttttccgttacgtccgtacgtaccgttaggttaccgtacggtaaaccgtcggttaccgggttacccgttttaaccggttaccgggttttacccggggacgggggttaacccggggtaaacccgggttaacgggggttaccgtaaccccgtaaacggtaaaaccgtaaccggttcgggttacggtacccggtacggtacccgtaaccgttaccgtttaccgttaccggtttactttcccggtacggtttccccctttacccccggacccgtttaccgtaccgtaacgg

SEQ ID NO: 6005 - DNA, 828 bp, Homo sapiens
  misc_feature: GYAE6OF02H3RCO.8.28.C06.1.454.CMB.1.raw
  modified_base (142)..(142): a, c, t, g, unknown or other
  misc_feature (142)..(142): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (285)..(285): a, c, t, g, unknown or other
  misc_feature (285)..(285): n is a, c, g, or t
  modified_base (544)..(544): a, c, t, g, unknown or other
  misc_feature (544)..(544): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctccagagntcagttggagaaggtggtgatgacacacgtctcccggtcacccgtgttcgtttcgttttccgngggganacgtacgccctaccctcgtccgtgtcgaccgtcagtacgagcgttaggtaaggaccgtaacgttcgactggtancgacgcgaggacggtccggtcggaccgacggtcctaccgaacgtcctctactacgttccgttcggaccgttaaccgttaacggacggtcctaggtacgtaaccctccgaacggtaccgtacggtaccgacgggcgtacgtacgggtcggttacggtcggtactttaccgttaccgtcgttccacctaccgtaactacctaaaccgtaaccgtcgtaaccgtaattcccgtaggtaaccgttcgtttcgtaaccgttttnttttaccgttactggtaacctcgtaccgttaacgttacgtaaggttaacgttccggttaacccgggtttcccgttaaccggtttaccgggtttaccggggaacccgggttaggggtaaacccggtttacgggtaacccgggttaaaacgtacccgggtaaaacggttaccggttacgggtaccggtaaccgtacccggtaacctaacggttccgtttaaccgttccggttactttacccggttaaccctttcccccgggtacccggttacttaccggttaccgg

SEQ ID NO: 6006 - DNA, 755 bp, Homo sapiens
  misc_feature: GYAE6OF02FMOL5.8.28.C06.1.454.CMB.1.raw
  modified_base (161)..(161): a, c, t, g, unknown or other
  misc_feature (161)..(161): n is a, c, g, or t
  modified_base (175)..(175): a, c, t, g, unknown or other
  misc_feature (175)..(175): n is a, c, g, or t
  modified_base (201)..(201): a, c, t, g, unknown or other
  misc_feature (201)..(201): n is a, c, g, or t
  modified_base (270)..(270): a, c, t, g, unknown or other
  misc_feature (270)..(270): n is a, c, g, or t
  modified_base (691)..(691): a, c, t, g, unknown or other
  misc_feature (691)..(691): n is a, c, g, or t
tcagctcgcgtgtccacgaccggtgctcgatttagagctcacgtattgggtttgggagaactgctcagttaggacccagacggaaccagtggaagccccaagcgcagcttctcttcctcctgctactcgtggctctcagtagatcattggacgaagtggtnatgtacacgagtcnccggtcaccctgtcttcgttttccgngggatacgagcccacctctcctgtacgcgccagtaccagagtcgtaagtacggaactacgcctggttancagcaggtacggtcctcgggccaaggtcctacccgaggtacccttccacgtacttaccggttggacccgttaacccgtttaacgaacgggtaccctaaggttacggtaaaccttcccgacgtaccccggttaggttaccgccggtacggccgttaagggttcggggtaccttacgggggttaacctttcggtttaccacggttcctacgacctacgtacgaaaacctaccgtgaacctacgtacgtacggacgttacctttggtacttacgttttaacgttccgtgttaccgtaacgtaccttaggtacctaaggacggttacctccggggtacctacttacccgggtttacgggacgtaacgggtaacgtagggttaccgaaccgttaaactaacggcttaacgggtaccgtccggtaanccggtaaccgttacgttaaccttcgggttaccttcgtaacccgttcccttaccccagttacccg

SEQ ID NO: 6007 - DNA, 876 bp, Homo sapiens
  misc_feature: GYAE6OF02G3I96.8.28.C06.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (285)..(285): a, c, t, g, unknown or other
  misc_feature (285)..(285): n is a, c, g, or t
  modified_base (336)..(336): a, c, t, g, unknown or other
  misc_feature (336)..(336): n is a, c, g, or t
tcagctcgcgtgtccacgaccggtgctcgatttagagctcacgtattgggtttgggaggaactgctcagttaggacccagacggaaaccagtaggaagccccagcgcagcttcctcttcctcctgctactctgctccgagagatcagttggagaagtggtgagtgacacagtctccggtcaccctgtcttgttttcgnggganagancctaccctctccgtggtcgcggacctagtcgaggtacggtcgttaacggaaccgtaaacttacggccggtaggttacncagtacgaggacggtccgtcggaccgcggtccctaccgacgacccttccgntacctttcgttacgggtccgttaccgtttaaacgggccgggtaccgtaagggttaaccgaacccgtcccgtaaaccggtaccgttacgggttaccgacggtacgggtcgtaacggggttcgggttaaccggtcggttaaccgttccgtttacacttccgtaacaccgtaaatacgtaaactaccgtagaacttaacgtcgtaggtaccgttcgttacgttacgtttaacgttttcttaggttaccgaaccgtacgttaacgttcccggttagtaaggggttaccttaccgggtaagggttttccccgttacggtttaacccggggttaaccggggaacccggggtttaaacgggaaccgggggttaacggggttaacccgtaaacccggttaaacggtaaaccggtaccgttttaccggggtacggttacccgttaaacccggaccggtaccgtttacgtttacccggttaacccggttttccttaacccggttaccccggtttacccgtacccccgtttacgtttaaccgtaccccggg

SEQ ID NO: 6008 - DNA, 942 bp, Homo sapiens
  misc_feature: GYAE6OF02FRPNU.8.28.C06.1.454.CMB.1.raw
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctgggganagacgcctaccctctcctgtgccggccagtccagagtcggttaggacgaaacgttcgccgtaggtactcgagtacaggacggtcccgtgggaccaacgggtcccctaccccgaaggacccttcccgtactaacgtttccgtttcgggaccgttacccgttttaaacgacggggtcctagggttacggaaactccccgaggtacccgtaggtttaccgaacgggtccgggcgtaacgggttcgggggttaccgtttacgggggttacccgtttttaccgggttacccggtaacctttcccggttaacccgtaaccccttaaaccgtttaacccggtaaaaaccttttaaacccccgtttacggtaaacccgttaaaccgtttcccgtttaaccgggtaaacccgttttaaccgttttacccgggtacgtttttaaaccgtttttttacgtttaccggttacggttacccttaaacggttaccggttaacgtttacccgttaaccgggttaaagtaccggtttcccgggttaccggttttaaccgttaccgggtttaccggggggtacgggttaaccggggtacccgtaaaagggggttcccgttaaacccgtaaccggtaaaccggttaacggttacgggtacccggtacggtaccgtaacctaccggttaaccgttcgttacgggtttccttaacggtttcccccgttccccggttaacccgtattacccggttaaccgg

SEQ ID NO: 6009 - DNA, 125 bp, Homo sapiens
  misc_feature: GYAE6OF02IDH6S.8.28.C06.1.454.CMB.1.raw
  modified_base (121)..(125): a, c, t, g, unknown or other
  misc_feature (121)..(125): n is a, c, g, or t
tcagctcgcgtgtccacgaccggtgctcgatttagagctcacgtattgggtttgggggaggaactgctcagttaggacccagacggaaccatggaagccccagcgcagcttctcttcctcnnnnn

SEQ ID NO: 6010 - DNA, 1061 bp, Homo sapiens
  misc_feature: GYAE6OF02HKWQU.8.28.C06.1.454.CMB.1.raw
tcagctcgcgtgtccacgaccggtgctcgatttagagctcacgtattgggtttgggggaggaactgctcagttaggacccagacggaaccatggaagccccagcgcagcttctcttctcctgctactctgcctaccagagatcattaggagtaagtggtgatcgacacagtctccggtccacctgttctttgttttccgaggggagagcgacccacctccgtcctgtcggcggacctagtcaggagcgggttaacggactaacgttcgccgttaggtatcgacggcgaggtaccggcctcggggaccacggcccgtaccgtagtaccctcccgtagtacgtttccggttacggggacccgttaaccgtttaaacgggccggggtactacgggtaaccggaaaccctccggtacggtacccggtaaggttcccgcggggtacggtaccggttagggtttacgggggtaccgtttacggggtaccttttcccgggtttaacccgacccgtttacgttaccccgaaaacccttaacccgttaacttaaaacccggttaacccgtacgttaaccctaagggtttccccggtttaaaccggttaccgggttttaaccgtttaccggtttaacgttttaaccgttttttaacgggttaccccgtttaggtaaccgttaaccggtaccggttttaaagtacccgggtttttaaaaggacccgtttaacccgggggtttaccggttttaccccgggtttttaacccggttttacccggggggttaccccgggggtaaacgggggttaaccccgggttaaaacccggggggtttaacccggggtttaacccgggttaaaacccccggttaaaccggggtaaaaccccggtttacgggacccggggggtttaccggttaacccgggttaacccgtaacccgggttaaacccggttttaccccgttaccggggtttttacccggtttaaccccggttttaaccccgttacccggtttttaaaccccccggggttacccccttaccgggggtttaaccccttaaccccggggg

SEQ ID NO: 6011 - DNA, 905 bp, Homo sapiens
  misc_feature: GYAE6OF02GH7TU.8.28.C06.1.454.CMB.1.raw
  modified_base (204)..(204): a, c, t, g, unknown or other
  misc_feature (204)..(204): n is a, c, g, or t
  modified_base (560)..(560): a, c, t, g, unknown or other
  misc_feature (560)..(560): n is a, c, g, or t
tcagctcgcgtgtccacgaccggtgctcgatttagagctcacgtattgggtttggggaggaactgctcagttaggacccagacggaaccatggaagccccagcgcagcttctcttctcctgctactctggctccagacgatcagttcggagaacgtggtgattgacacagtcctccggtacacccgtgtccttagtttttccgnggggatacgacgcctacccgtctccgtggtcgccggcctaggtccagtacggtcgttaaggaccgtaacttagccttaggtacttcgagcgaacggacgtcccgtcgggacctacgggccttcccgaaggtacctcccgtacgtactttccggtttacggtcccggttaacctttaaacgggaccggggttacccgaagggttaccgggtaaaccgttaccccggacgtacccgggtaaccgggtttacgaccgggtaccgggtacggtaaggttcggggttaccgtacggggttacccgtttacgttaacccgtcgttacctacaacctagttaacccgtaaaattaccccggtnaaccgtaacgttaccgtacggtaccttaggtttaccgtaacgtttaacgttttacgtttacgtaccggttaccgtacgttaacgtacggttacgtaacggttaaccgtcgtttaacccgggtccgtttacgttacccgggtttacggggacccgggttaaacgggtcccggttaaaaggggttacccgtaacccggttaaaaccggaacggtttaccggtaacggggtttccggacccggttaaaccggtcccgttaaccggtacgttttacccggttacctttcccttaaccggttttaccccggttcccgttaaccccgttaacggttacggttaacccccgg

SEQ ID NO: 6012 - DNA, 734 bp, Homo sapiens
  misc_feature: GYAE6OF02HKM4C.8.28.C06.1.454.CMB.1.raw
  modified_base (144)..(144): a, c, t, g, unknown or other
  misc_feature (144)..(144): n is a, c, g, or t
  modified_base (163)..(163): a, c, t, g, unknown or other
  misc_feature (163)..(163): n is a, c, g, or t
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
  modified_base (553)..(553): a, c, t, g, unknown or other
  misc_feature (553)..(553): n is a, c, g, or t
  modified_base (561)..(561): a, c, t, g, unknown or other
  misc_feature (561)..(561): n is a, c, g, or t
  modified_base (724)..(724): a, c, t, g, unknown or other
  misc_feature (724)..(724): n is a, c, g, or t
tcagctcgcgtgtccacgaccggtgctcgatttagagctcacgtattggggtttgggggaggaactgctcagttaggacccagacggaaccatggaacgccccagcgcagcttctcttcctcctgctactctggcctcccaganatcagttggagaagtggtnatgacacgagtcctccggtccacccttgttcctttcggtttttccgnggggganagaccgcccaccctctccgtggtcgccgacagtcaggtagtacggttaacggaacggtaacttacgccgtaggtactaccacggcgaaggtccggccgtacgggaccgaccggtcccctacccgaacgtacccttccgtacttcgtttccggtttacggtcccgttacccgtttaacggacgggtaccgtaaggtacgaaccgtcccgacgtccggtaacggtcgacggcgtaggtggtcggtcggtacgggttcttcgttacacttcgtaccactactaactaactacctgtactactccgtagtaccgttagttcgttatttcgtttacttcgngttaccgnttaccgtagttacgtacgtaacggtacgttccggttaccgttcggttaaccggttcgggacgggtaccggtaacgtacgggtaccgtaaactaaccgggaacgtacgtcggtcgcctcggacctacgtcttacggttcttcctacgttaccgtcccgttaccncgttctacgg

SEQ ID NO: 6013 - DNA, 825 bp, Homo sapiens
  misc_feature: GYAE6OF02HRRV1.8.28.C06.1.454.CMB.1.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcagttggagaagtggtagatgacacagtcctccggtcaccctgtcttgttttccgngggganagacgtcccacccttctccgtggtcgcggacctagtcgagacggtacggttaacggacgtaacttacgccgttaggtaactcgacgtacgaagggtaccggccgtacgggacccctacggggtcccctaccccggaacggtaccccttccccgtaacgttaccgttttccggtttaccgggtacccggtttaacccgggtttaaacggaccggggtccgtaacggggtaaccgggtaaccttaccccgacggtacccgtaacgggttccgaacgggccggtaaggacgggttcgggtacggtaccggggttacctttcggttacctacgtaccctactaaaccgtaaccgtaacctaacctaaccgggtataaccgtaacgtttccgtaacggtaccgtttagttacggttacttacgtttttaacgttctacgtaagtcttcgtacgtgttaacgtacgcgttaccggtcgttacggtacggtttcgggaacggaccggtaacgtaccggtccgaacgaacgttaaccgtaggtcgggttacggtccgagtcccttaaacgccgtttctacccgtttcgttaccgtacccttcccggtttacccagttacccgttacgg

SEQ ID NO: 6014 - DNA, 819 bp, Homo sapiens
  misc_feature: GYAE6OF02H1MLR.8.28.C06.1.454.CMB.1.raw
tcagctcgcgtgtccacgaccggtgctcgatttagagctcacgtattggggtttgggggaggaactgctcagttaggacccagacggaaccatggaagccccagcgcagcttctcttcctcctgctactctggcctccagagatcagttggagaaggtggtgatgacacagtctccggtccaccctgttcttgtttttccgtggggagagacgccaccctctccgtgtcggcggaccagtcagtcgcgttaaggaacgtacgttacgccgtggtactacagacgaggacggtccgtcggaccgtaggccgtacccgaggtaccttacctactacgttccgtttcggtccgttaaccgtttaacgacgggtaccgaaggtacggtaacctcccgacggaccgttagggttaccgacgggacggcgtagggttcgggtcggtacgggtactttccgggttactaccgttctaccgtaacctacgttaaccgtaaacttaacccgtacggaaactacgttacccgttaacggtaaccgtttacgtttacggttaacgttttacgtttttacgtttacgtttcgtaccgttaacggttcgtttaacgtacggttaacggaacgttaccgggtcggttaccccgtttacggttaccggtttcccggggaacggggtaaccgggtaaccggtaaaccgggtaccggtaaccgtaaaccgtaaccgggtacgtacgggtacgtacggtacgaacccgacgttacttcccggttacgttaccgtttaccgtacccgttcccgtttacccggacctttacccgtaagg

SEQ ID NO: 6015 - DNA, 775 bp, Homo sapiens
  misc_feature: GYAE6OF02I7SVO.8.28.C06.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (503)..(503): a, c, t, g, unknown or other
  misc_feature (503)..(503): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccaccctctccgtgtgccggccaggtcagngcgttaagacgtaattcgcctggtatcagcgagacggtccgtaggcccgaggcctacccgaagtacccttcctacgtacgttccgtttcgggaccgttaaccgtttaaaccggacgggggtacctagggttacgggaaccctacccggaacgtaccgttaacgggttccgaccgggacggtaccgtagggttcggggtacgttacggggttaacctttcggttacgacccttcacctaaccgtactaacgtaactttaacccgntaacctacgttacgtacggtaaaccgttcgtttacggtaacctttaggttttacttaccgttcgtaaccgtacgttccgttaagtccgtaagtaaacggtccggttacgggttacctttacgtacggtttaccggggacggtaacggggaccgtaacgggtaaccggtaaaccgtaacgaaacgggttccggtaggttaccggagttcccgaaacctccgttagttccgttacgttccttaagtcccttacctaccggtacgtacgttacgg

SEQ ID NO: 6016 - DNA, 786 bp, Homo sapiens
  misc_feature: GYAE6OF02H3Q5I.8.28.C06.1.454.CMB.1.raw
  modified_base (171)..(171): a, c, t, g, unknown or other
  misc_feature (171)..(171): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (492)..(492): a, c, t, g, unknown or other
  misc_feature (492)..(492): n is a, c, g, or t
tcagctcgcgtgtccacgaccggtgctcgatttagagctcacgtattgggtttgggggaggaactgctcagttaggacccagacggaacatggaagccccagcgcagcttctcttcctctgctactctggcctccagagatcagttaggagtaagtggtgatagactacgngtcgtccggtcaccgtgttcttcgttttcgngggganagtacgccctacctcgtccgtgtcggcgcctagtcgagtagtacgttaggaactaacgtttcgcgttaggtactaccgaggacgtacggacggtccgtaggaccgaacgggtcccttacccgaacggttcctccgttactacgttccggtttccggacccgtttaccgttaaaccggtaccggtcgttaacggggtaccttaaaccggccccctaagggtaccccttaaggttcccgacgggacgtcggtacggttacggtacgggtcgttaacgttcccgttnacccgtaccgtttccgaaacgttacaaccgtaactacgtacgactaacttcgtacggtaacgtttacgtcgttacgttattacgttcgtacgtactagttaccgtagttacaaggttaacccgcgttaccggctttaccgttaccggttcgggaaccgggtaccgaccgggttacgttacggaccttaacgggaagttaccgtcggtagtaccgtcgtaaccggtaccaccgttttaccgacggtttccttaccgtccccgttaccgttccccgtaaccggtccgttaacccgg

SEQ ID NO: 6017 - DNA, 755 bp, Homo sapiens
  misc_feature: GYAE6OF02FKXRZ.8.28.C06.1.454.CMB.1.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcagttggagtaagtggtgatgacacagtccgtccggtcacccttgtctttcgtttttccgnggggacagacgccctaccctctcctgtcgccggccagtcagngtcgttaggacgaacttcgccgtgtactcgagtcgagacggtcctcggaccgnggcctaccgactacctcctactactttcgttcggccttaccgtttaacggacggacctaaggtcgaaccgtccgacgtccgtacggttcgacggcggacgtacgggtcgggttgtacgggttaccgtttcggtactaccttcctacgaaccgtattaccctaaacgttacccgtgaaccttaacgttccgacgtaaccgttacgtttacgtacgtttaacgttttacgtttcgttaccgtacgtaccgttacttacgtacgtacggtacgtaccggtccggttacccgttacggttaccgggttcgggacggggtaacggtaacccgggtacgggtaccgtaaccgtaaaccgtaaccgaccggttacggtaccggacgttacccgaccgttaacgtacgttaccggttacgttaccttaccgtacccgttccgtacccccgtacgttacggtaccg

SEQ ID NO: 6018 - DNA, 772 bp, Homo sapiens
  misc_feature: GYAE6OF02J1LQ1.8.28.C06.1.454.CMB.1.raw
  modified_base (200)..(200): a, c, t, g, unknown or other
  misc_feature (200)..(200): n is a, c, g, or t
  modified_base (571)..(571): a, c, t, g, unknown or other
  misc_feature (571)..(571): n is a, c, g, or t
tcagctcgcgtgtccacgaccggtgctcgatttagagctcacgtattgggtttggggaggaactgctcagttaggacccagacggaaccatggaagccccagcgcagcttctcttcctctgctacgtctggcctcccaggagatcgattgggagaaggtggtgatgacacagtctccggtcacctgtcttggttttccgngggagtagcgccaccctctctggtcgcggacacgtcgagacgcggtacgacgtaacgttacgtccgtggttaagtccaggcgaggtacggccgtaggcccaacggtccgtaccccgagtcccgttcgtaccgtacgttcgtttcgggccttaaccgtttaacggacgggtaccgtaggtcgggtaaacttccccgaacgtaccggtacgttcgaacgcgggtacgaggttcgggtacggtcggtcgtttcgtacgtacgttcgtaccgtaccgtactaacctaacggtaactcgtaactacgttacgacgtaacgtttacgttcttcgttaaacgttttcttaccgttgtcggttaacgtcgtaaccggtnttaacgggaacgttaccggttacccggtccgtttaccggttacgttaaccgggtacggggtaaccggtaacccggtaaaggttcccggaaacttaaccgggaaacgttacggtggtaccgtaccggttactaccggttatacccggtttacgtcgttacgtttaccgccgttcccggtttccctaccggttaattcccggg

SEQ ID NO: 6019 - DNA, 838 bp, Homo sapiens
  misc_feature: GYAE6OF02HOQ7Q.8.28.C06.1.454.CMB.1.raw
  modified_base (164)..(164): a, c, t, g, unknown or other
  misc_feature (164)..(164): n is a, c, g, or t
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatganacaggtctccggtcacctgtcttgtttttcgnggggagtagacgcccacccttctccgtggtcgccggcctagtcagacggtcggttaacggaacgtaacttacggccgttaggtactcgagccgaggacggtcccgtggaccgacggtacccctacccgaacgtaccgttcccttaacgtcgttttccgggtttacgggtaccccgtttaccgttttaaaaccgggaccggggtccgtaacgggttaccgggaaacccttccccgaacgggtaccgttaacggggttaccgacgggtccgggtaggtaacgggttcggggttaccggtcgggggttacctttcccgggtttaacctccgtccgttaaccctaaccgtaaacgtaaccttaaaccgtttaaccgacggtactaaacgttaccgtacgttaaccggtttacgtttacgtacgtttacgtttttacgtttctaacggtacctaggtaccgttacggtacgttaacggacgttaccggttcggttcccggtttacgttaccggttccggggaaccggtacgggaaccggttaacggtcggtaaacccaaggtaacccgtagtcgggtacgtaccgacgtaccgtaacgtcgtacgttcgttacccttacgtaccgtttccctaaccgtcctagtacg

SEQ ID NO: 6020 - DNA, 876 bp, Homo sapiens
  misc_feature: GYAE6OF02FLOHU.8.28.C06.1.454.CMB.1.raw
  modified_base (200)..(200): a, c, t, g, unknown or other
  misc_feature (200)..(200): n is a, c, g, or t
  modified_base (281)..(281): a, c, t, g, unknown or other
  misc_feature (281)..(281): n is a, c, g, or t
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
tcagctcgcgtgtccacgaccggtgctcgatttagagctcacgtattggggtttgggggagggaactgctcagttaggacccagacggaaccatggaagccccagcgcagcttctcttcctcctgctactctggctcccagagatcattggagaagtggtgatgacacagtctccggtcaccctgttcttgtttttccgnggggagagacgcccaccctctcctgtcgcggccagtcagacgtcggttaaggaaccgtaaacttacggaccgtggttaacncgaaggccaaggacggccctagacccgagggtcccnccctaagacccttccgtntactttcgtttcgggaccgttaacccgtttaacgcggggaccctaggtaccggaaccttcccgaggtacccgtagggttccacgggccggtcgtagggttcggggttacgtacggggtaccttttcgtacgtaccgttaccgtacgaaccctagttacccaaaacgtttaacccgtagtactaaacgttccgtacggtaaccgttacgttttacgtacggtttacgtttttaacgtttccttacggttaccgtagtaccggtaacggttaccgttaagggaaacgttaccggtttccggttacccggtttaccgttaacccgggttttaccggggaaaccggggtaccggggtaaacccgttaacggggtacccggtaaacccggtaaacccggttaaaaccgggtaacccggtttacgggtcggtacccggttaccggtaaccccgtaacccggtttacgttaaccgttttacggttaaccgtttacccgttaaacccggtttcccccggtttaccccgtacccgttacggttaacccgg

SEQ ID NO: 6021 - DNA, 813 bp, Homo sapiens
  misc_feature: GYAE6OF02HO9O5.8.28.C06.1.454.CMB.1.raw
  modified_base (601)..(601): a, c, t, g, unknown or other
  misc_feature (601)..(601): n is a, c, g, or t
  modified_base (804)..(804): a, c, t, g, unknown or other
  misc_feature (804)..(804): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctccagagatcagttggagtaagtggtgatgacacagtcgtaccggtcacccgtgttcgtttacgttttccggaggggagtacgacgccctaccctcgtccgtggtcgccggacacggtacgagtacggtacggttaacggaaccgtaacgttcgccgttaggtactcgacgacgtaaggcggtccgtcgggacctacggccctacccgaagtacccttccgcgtaaccgtttcgttcggtaccgtaacccgtttaacggaccggtaccgtaaggtacgtaacccgtcccgacggtacccgtaggttaccgacggtccggtacggtacggttcggggtcgttaccggggtacctttacgggtttacaacgtttccgaccaacttacgtaacctaaaccgttacgtcgtaacctaagttccgtaacggtacctttaacgttcgtacgtttagtttacgttcgtacgttnacggtacttacgtactacggtaaccgtcggtcccggttagttacccgttacggttaccgggaaccgggtaccggttaacggtacgggttaacccggtaactaaacggttaacgtaaccgtcggttaaccggtccgtaacgtaaccgttcgtaaccgttgtttaccgttaccttaaccggttccttacccggttaccaccgttntaaccccgg

SEQ ID NO: 6022 - DNA, 842 bp, Homo sapiens
  misc_feature: GYAE6OF02GEX7P.8.28.C06.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
tcagctcgcgtgtccacgaccggtgctcgatttagagctcacgtattggggtttgggggaggaactgctcagttaggacccagacggaaccatggaagccccagcgcagcttctcttctcctgctactctggctccagagatcattggagaagtggtgatgacactagtctccggtcacctgtcttgttttcgnggganagcgcctaccctctccgtggtcgcggcctagcgaggacggtcggttaaggaacgtaacttacgccgttaggtactcgagcgaggacggtccgtcgggaccgacggtacctacccgaacggtacctccgtactacgtttcgttccggtaccgttaccgtttaaccggacgggtccgtaggtacgggaaccctccgtaacgacccgttagggttacgacgggtcggacggttacgggttcggggttccggtacgggttaccgttttcggtttaccaccgttacctaccgtaaccgtactaaaccctaaacgttaacccgtacgtaaccgtaacgttacgtacggtaaacgttacgtttaacgtaacgttttacggtttttaacctttcgttaccgggtaccttacgggtaacgttacggttacgttaacggaacggttcggtttccgggtttaccgtttacccggtttacgggtttaccggggaaccgggggtaaccgggttaaccgggttaacggggtaaaccccggtaaccggtaaaaccgtaaacgtaccggttagggtacggttccggtaacgaccgtacctaacgttccgttacgttaactttcccgtaccttccccggtccgttaccgtagttaaccgg

SEQ ID NO: 6023 - DNA, 783 bp, Homo sapiens
  misc_feature: GYAE6OF02JX7PE.8.28.C06.1.454.CMB.1.raw
  modified_base (197)..(198): a, c, t, g, unknown or other
  misc_feature (197)..(198): n is a, c, g, or t
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (296)..(296): a, c, t, g, unknown or other
  misc_feature (296)..(296): n is a, c, g, or t
  modified_base (379)..(379): a, c, t, g, unknown or other
  misc_feature (379)..(379): n is a, c, g, or t
  modified_base (445)..(445): a, c, t, g, unknown or other
  misc_feature (445)..(445): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccgagagatcattggacaagtggtgatgacacagtctccggtcacctgtctgttttcagggnnganccacctntcctgtgcgctagtcagngtcgttaaggactacttagccgtggtatccgagcgacgtacggcgtggccaggtcctcccagtactccgntacgtcgtttacggccttccttaaacgcgggacctaggtaccgtaactccccgagtcccgtaaggttcacggtccggtaacgnggttacgggtcctaggggtaccttacggtccctacgtcctaacgcctaacctagaaacctaccgtnaaccgtagttacctacgtacgtacgtttacggtctttagtttacgtttacgtacgtaccgttaagacgttaccgtaaccggttggtaaaccgttcgttaaacgggttcccgttacggttaacccggttttacgggaacccgggttaaccggggtaaaacccgtttaccgggggtaaacccgggttaaacccctaacgggttaaaaacccgtccggtttacggttaacccggggttactaaccggttaacccgtaaccgttaaaccgttcccgtttaaacgtcccgtttaaaacgttacccgttccccggtttaaccctaccgtttaccggttaaccgg

SEQ ID NO: 6024 - DNA, 331 bp, Homo sapiens
  misc_feature: GYAE6OF01EWS7M.24.76.G10.1.454.CMB.1.raw
  modified_base (329)..(331): a, c, t, g, unknown or other
  misc_feature (329)..(331): n is a, c, g, or t
tcagactactatgtcacgaccggtgctcgatttagtcactcatacagggtgtacacctgtggttctcggggctgccctttggttttggagatggttttctcgatggggctgggaggcctttgttggagaccttgcacttgtactccttgccgttcagccagtcctggtgcacgacggtgaggacgctgaccacacggaacgtgctgttgaactgctcctcccgtggctttgtcttggcattatgcacctccgagagcacagcggccctgggctgcctggtcaaggctacttccacatagtagtctgagcgggctggcaaggcgcatagnnn

SEQ ID NO: 6025 - DNA, 707 bp, Homo sapiens
  misc_feature: GYAE6OF01ASYGL.24.76.G10.1.454.CMB.1.raw
tcagactactatgtcacgaccggtgctcgatttagtcactcatacagggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagctggtggagtcgtgggggaggcgtggtccagcctggggaggtccctgagactgtcctgtgcagcgtctggacacatcttcaatacctatggcatgcactgggtccgccaggctccgaggcgaagggggctgggagtggggtggctaggtttatttgggtttgagttggaaacttaatgaaattactatggctagagttcccggtaggaaacggggcccgtaagtttccaacccgtattccgtacccgaaggtaacgtaacctaaatttcccgaagggtaacgttaagtttttaggtaactttccgtttacgtaagtaacttacggtaaacctaacggtacccgttaggaacgggttaggttaccgggaaacgggaccggtaaccgggtaccttaagttaggttaaacgtttaacccgttagggttacgggtaccggtaagttacgggaaaaacggtcggtaaagggggtaagggttaacggttaggggtttaccgggaaggggttaggggggtaacgg

SEQ ID NO: 6026 - DNA, 748 bp, Homo sapiens
  misc_feature: GYAE6OF01C0VVZ.24.76.G10.1.454.CMB.1.raw
  modified_base (300)..(300): a, c, t, g, unknown or other
  misc_feature (300)..(300): n is a, c, g, or t
tcagactactatgtcacgaccggtgctcgatttagtcactcatacaggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctgggtggagtcgtgggggaggcgtgggtccagccgtggggaggtccctgagactggtcctgtgcagcgtctggacacatcttcaatacctatggcatgcacgtcgggtccnccaggcctccgaggcgaaggggctgggagtgggtggctaggtttagttttgggtttgaagttagggaaacttaagtagtaaacttacgtaagtggacgtaagtacggttacccggtaggaaacggggtacccgttaagtttacccgaaccctaacgttcccgttacccgaaaggtaacgtaaacctaaacgtttaccccgaaagggtaacgttaaagttttttggtaactttaccgttttaaccgaaggttaattacggtaaaccgtaacggtacccgttaggaaacggtaacggttaaccgggaacgggaaccgtaccgggtacttaagtttacggttaaacgtttaccgtagggtttacggaaccggtaagttaacgggaaaaacggtcggaaaggggtaagggtaacggttaggggtttaccgggaaggggttgggggtaaacgg

SEQ ID NO: 6027 - DNA, 533 bp, Homo sapiens
  misc_feature: GYAE6OF01CJT69.24.76.G10.1.454.CMB.1.raw
  modified_base (456)..(456): a, c, t, g, unknown or other
  misc_feature (456)..(456): n is a, c, g, or t
  modified_base (478)..(478): a, c, t, g, unknown or other
  misc_feature (478)..(478): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcacgtggggtccgccaggcctccgagggccaagggggcctgggagtggggtggctaggtttatttggtttgatggaaactaatgaatactatgacagagtccgtggaacgggcctattccacctatcctaccaggacacaattccgaggataattttgatcttcagtatgaacngcctgagagtcgaggacacggntatgtattactgtgcgagtgaaagcgaaggtacggtagtgggtcgaggtgggacg

SEQ ID NO: 6028 - DNA, 542 bp, Homo sapiens
  misc_feature: GYAE6OF01BZD6E.24.76.G10.1.454.CMB.1.raw
  modified_base (294)..(294): a, c, t, g, unknown or other
  misc_feature (294)..(294): n is a, c, g, or t
  modified_base (441)..(441): a, c, t, g, unknown or other
  misc_feature (441)..(441): n is a, c, g, or t
  modified_base (481)..(481): a, c, t, g, unknown or other
  misc_feature (481)..(481): n is a, c, g, or t
tcagactactatgtcacgaccggtgctcgatttagtcactcatacagggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagccgtgggaggtccctgagactgtcctgtgcagcgtctggacacatcttcaatacctatggcatgcacgtgggtccncaggctccgaggcgaaggggctgggagtgggtggctagttagttggtttgatggaaactaagtgaatactatgcagagtccgtagaaggccattcacatcctcagagacaatccaggaactaattttgtatcttacgagatagaacngcctgaagtagtacgaggacacggcttaatgtaattaccnggttgacggtataggaaaaggtcgaagggaaggtagttaggggttacggaggtggggtacg

SEQ ID NO: 6029 - DNA, 521 bp, Homo sapiens
  misc_feature: GYAE6OF01BMD03.24.76.G10.1.454.CMB.1.raw
  modified_base (294)..(294): a, c, t, g, unknown or other
  misc_feature (294)..(294): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctggggaggtccctgagactgtcctgtgcagcgtctggacacatcttcaatacctatggcatgcactgggtccnccaggctccaggcaaggggctgggagtgggtggctagttattggttgatggaactaatgaatactatgcagagtccgtggaacgggccattcaccatctccagagacaattccaggagtaattttgattcttcagtatagaacagcctagagagtcgaggacacggctagtgtattactggtcgcgatggaaagcgaagggaggtagtagggttcgagggtgggacg

SEQ ID NO: 6030 - DNA, 520 bp, Homo sapiens
  misc_feature: GYAE6OF01EZYR3.24.76.G10.1.454.CMB.1.raw
  modified_base (295)..(295): a, c, t, g, unknown or other
  misc_feature (295)..(295): n is a, c, g, or t
  modified_base (487)..(487): a, c, t, g, unknown or other
  misc_feature (487)..(487): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctggggaggtccctgagactgtcctgtgcagcgtctggacacatcttcaatacctatggcatgcactggggtccnccaggctccaggcaaggggctgggagtgggtgctagttattggttgatggaactatgaatactatgcagagtccgtgaagggccattcacctatctcagagacaattccaggataattttgtattcttcagatgaacagcctagagagtcgaggacacggtctagtgttattactggtgagtagtgaaacgngaagggtaggattgggttacgagggtgggtacg

SEQ ID NO: 6031 - DNA, 757 bp, Homo sapiens
  misc_feature: GYAE6OF01CBCGK.24.76.G10.1.454.CMB.1.raw
  modified_base (298)..(298): a, c, t, g, unknown or other
  misc_feature (298)..(298): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggagcgtggtccagcctgggagtccctgagactgtcctgtgcagcgtctggacacatcttacaatacctatggcatcgcacgtcggggtcccnccagggcctccgagggccgaagggggctagggagtggggtaggctaggttttagtttgggtttagagttgggaaacttaagtggaaatactagtcgacgtaaggtacggttccggtaggaaacgggggtcccctaagtttccgaacccgtaattaccccgtacccgaaaggtaacggtaaacctaaacgttttaccccgaaagggtaaagtttaaacgtttttttacggtaaactttccgttttaccgaaaggtaactttaacggaaacgtaacggtacccttagggaacgttaacgggttacgggaaacgggtaacccgtacgggtacctttaagttacggtaaacttttaaccggtgggttacggtacggtaaaggttaccgggaaaaggtaccggtaaagggggtaagggtaacggttagggggttttaaccgggaaggggtttgggggaaaccgg

SEQ ID NO: 6032 - DNA, 502 bp, Homo sapiens
  misc_feature: GYAE6OF01BF7VF.24.76.G10.1.454.CMB.1.raw
  modified_base (430)..(430): a, c, t, g, unknown or other
  misc_feature (430)..(430): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactgggtccgcaggctccaggcaaggggctggagtgggtgcagttattggttgatggaactaatgaatactatgcagagtccgtgaagggccgattcaccatctccagagacaattccaggagtaattttgattcttcagatgaacngcctgagagtcgagacacggctagtgtattactgtgcgatgaaagcaagggaggattgggtcgaggtgggag

SEQ ID NO: 6033 - DNA, 690 bp, Homo sapiens
  misc_feature: GYAE6OF01C5CUU.24.76.G10.1.454.CMB.1.raw
tcagactactatgtcacgaccggtgctcgatttagtcactcatacaggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagccgtggggaggtccctgagactgtcctgtgcagcgtctggacacatcttcaaatacctatggcatcgcacgtcggggtcccgccagggcctacccgagggccaaagggggcctagggaggtggggtgggctaaggtttagtttggtttgaagttgggaaacttaagtgaaattactaatggactaaggacgttccggtaggaaacggggccctaattcccaaccctattcccgtaccaaggaacgtaaacctaaacgtttcccgaagggtaacgttaaatttttaggtaacttaccgtttacaaaggtaacttacggaaaaccgtaggtacccgttagggaacgtaacgggtacccggaaagggtaacccgaacggggtaccttaagttcggttaaactttaaccgtggttacgacggtaagtaggaaacgcgaaaggggtaggtaagttgggttacggaggtggggtacg

SEQ ID NO: 6034 - DNA, 503 bp, Homo sapiens
  misc_feature: GYAE6OF01B7WIX.24.76.G10.1.454.CMB.1.raw
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
  modified_base (433)..(433): a, c, t, g, unknown or other
  misc_feature (433)..(433): n is a, c, g, or t
  modified_base (495)..(495): a, c, t, g, unknown or other
  misc_feature (495)..(495): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctggggaggtccctgagactgtcctgtgcagcgtctggacacatcttcaatacctatggcatgcactgggtccnccaggctccaggcaaggggctggagtgggngcagttattggttnatggaactaatgaatactatgcagagtccgngaacgggccattcacatctccaganacaattccgaggagtaatttgtatcttcagtatgaacngcctggagagtcggagacgacggctagtgtatacgtgtcgcgatgaagcaggagagtggtgngtgggacg

SEQ ID NO: 6035 - DNA, 504 bp, Homo sapiens
  misc_feature: GYAE6OF01DX0QC.24.76.G10.1.454.CMB.1.raw
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (462)..(462): a, c, t, g, unknown or other
  misc_feature (462)..(462): n is a, c, g, or t
  modified_base (494)..(494): a, c, t, g, unknown or other
  misc_feature (494)..(494): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctggggaggtccctgagactgtcctgtgcagcgtctggacacatcttcaatacctatggcatgcactgggtccgccaggctccaggcaaggggctgggagtgggtggcagtttatttggttgatggaactaatgaatactatgcagagtcgtgaagggcatcacatcncaganacaattcagataatttgatctcagatagaacagcctgagagtcgaggacacggctatgtatactgtgngatggaaagcgaagggtaggagttgggttcgnggtgggtacg

SEQ ID NO: 6036 - DNA, 808 bp, Homo sapiens
  misc_feature: GYAE6OF01BP1YZ.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggaggtccctgagactgtcctgtgcagcgtctggacacatcttcaatacctatggcatgcacgtgggtcccgccgaggcctccgaggcgaagggggctgggacggtggggtggcgtaggtttagttttgggtttagaagttacgggtaaaacttaaagttacggaaaatttaaccgtaagttcggaccgtaagggtaaccggttccccgggtaagggaaaaccggggggtcccgtaaacgttttaccccgaaccccgttacttaccccgttacccgaaaggtaaaccggtaaaccttaaacgttttaccccgaaaggggtaacgtttaaagtttttttacggtaaactttcccgtttaccgaaaggtaacgtttaacggaaaaccgtacggttaccccgtagggaaacgggttacgggttaacccgggaaacggggtaacccggtaaccggggtacctttaaaggttacggtttaaactttaaccggttggttacgggtaccggtaaagttaacgggaaaagggccggtaaaggggtaagggttacggtttagggggttacggtaaggggttcgggggtaacgg

SEQ ID NO: 6037 - DNA, 620 bp, Homo sapiens
  misc_feature: GYAE6OF01EQG3C.24.76.G10.1.454.CMB.1.raw
  modified_base (295)..(295): a, c, t, g, unknown or other
  misc_feature (295)..(295): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcacgtggggtccnccaggcctccgaggcgaaggggctgggaggtgggtggctaggtttagtttgggtttgagttgggaaacttaatgtaaatactagtgcgaagacggttccggtggaaacggggcccgtaattccaccgtatcctaccagacgaactaacttccgaaggtaagttaatttttaggtacttcgtttacagtactacgaaacagtaccctggaacgtaggtacggaaggaccgacgggtcttaagtcgttaacttacgttggtcgtacgaagttaggaaaggcgaaggggtacgggtagtttagggttacgggtaggtcggggtaacgg

SEQ ID NO: 6038 - DNA, 582 bp, Homo sapiens
  misc_feature: GYAE6OF01EGW6B.24.76.G10.1.454.CMB.1.raw
  modified_base (492)..(492): a, c, t, g, unknown or other
  misc_feature (492)..(492): n is a, c, g, or t
  modified_base (547)..(547): a, c, t, g, unknown or other
  misc_feature (547)..(547): n is a, c, g, or t
  modified_base (571)..(571): a, c, t, g, unknown or other
  misc_feature (571)..(571): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggacggtccctgagactgtcctgtgcagcgtctggacacatcttcaatacctatggcatgcacgttggggccgccagggcctccgaggccgaaggggctgggaggtgggtggctaggttttatttgggtttagagttagggtaaacttaagtcgaaattactagtgacaggtacgtccggtaggaacgggtcctattccgaacctatcctaccagaacgtactaacttccgaaggtagttaattttgtatcttacgagtatacgaacngcgtagagagtcgaggacgacgctagtagttatacgtgtagacgtagtagaaagngaaagggtcggtagtgggttacgngggtggtacgg

SEQ ID NO: 6039 - DNA, 542 bp, Homo sapiens
  misc_feature: GYAE6OF01A5Q9D.24.76.G10.1.454.CMB.1.raw
  modified_base (479)..(479): a, c, t, g, unknown or other
  misc_feature (479)..(479): n is a, c, g, or t
  modified_base (496)..(496): a, c, t, g, unknown or other
  misc_feature (496)..(496): n is a, c, g, or t
  modified_base (507)..(507): a, c, t, g, unknown or other
  misc_feature (507)..(507): n is a, c, g, or t
tcagactactatgtcacgaccggtgctcgatttagtcactcatacagggggggagaggagcccagcactagaattcggcggtgtttccattcggtgatcagcactgaacacagaggactcaccatggagtttggcctgaactgggttttcctcgttgctcttttaagaggtgtccagtgtcaggtgcagctggtggagtctgggggagcgtggtccagcctgggaggtccctgagactgtcctgtgcagcgtctggacacatcttcaatacctatggcatgcactgggtccgccaggctccgaggcaagggggctgggagtgggtggctaggtttagtttggttgagtggaactaagtgaatacgtatgcagagtccgtagaagggccattcaccatctcagagactaatccgaggtagtaattttgtaattctttacgaagtactagaacagtcctaggacgtagtcgaggacacggntagtgtattacgtgtgngtagtgaaagngaagggaggtagttagggttcggaggtgggtaacg

SEQ ID NO: 6040 - DNA, 624 bp, Homo sapiens
  misc_feature: GYAE6OF01EJPT0.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagccgtgggaggtccctgagactgtcctgtgcagcgtctggacacattcttacaatacctatggcatgcacgtcgggtccgccgaggcctccgaggcgaaggggctggagtgggtgctagtttagtttggttgagtaggaaactaagtgaaattacgtatgacaggtacgtccggtaggaacgggtcctaattccgaaccctactcctaccgaagtacgaacctaacttaccgaaggtaagttaatttttgtacttcttacgaagtatacgaactacgtacctaggaacgtacggttacggaacggaccgtacggtacttaagttcgttaaactttacgtggtacgtacgtaagtaggaaagtcggaaagggtaggtagttaggggttacggtagggtggggtacg

SEQ ID NO: 6041 - DNA, 532 bp, Homo sapiens
  misc_feature: GYAE6OF01DKKKV.24.76.G10.1.454.CMB.1.raw
  modified_base (414)..(414): a, c, t, g, unknown or other
  misc_feature (414)..(414): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (509)..(509): a, c, t, g, unknown or other
  misc_feature (509)..(509): n is a, c, g, or t
  modified_base (522)..(522): a, c, t, g, unknown or other
  misc_feature (522)..(522): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggagcgtggtccagcctggggaggtccctgagactgtcctgtgcagcgtctggacacatccttcaatacctatggcatgcacgtcgggtccgccaggcctccgaggcgaaggggctgggagtgggtggctagtttagttggttgattggaaactaagtgaaatactatgcagtacgtcggtaggacgggcctattcaccatccacaganacaatcaggtatattttgatctnatatcgaacngcctaggagtagtcggagaccgacgntagtnttactagtgtcgagagtcgaaagcgaagggngtagtggtacggnggtgggtacg

SEQ ID NO: 6042 - DNA, 539 bp, Homo sapiens
  misc_feature: GYAE6OF01BW0KG.24.76.G10.1.454.CMB.1.raw
  modified_base (500)..(500): a, c, t, g, unknown or other
  misc_feature (500)..(500): n is a, c, g, or t
  modified_base (529)..(529): a, c, t, g, unknown or other
  misc_feature (529)..(529): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctggggaggtccctgagactgtcctgtgcagcgtctggacacatcttcaatacctatggcatgcactgggtccgccaggcctccaggcaagggggctgggagtgggtggctaggtttattgggtttgagtggaactaagtgaatactatgcaggagtccggtggaacgggccattcaccatcctccagagaactaacttccaaggacgtaattttgtattcttctagatgaactgacctaggagagtacggacggacgacggctatgtattacgtggtgngatgaaagcgagggacggagtgggtacgnggtggggacg

SEQ ID NO: 6043 - DNA, 518 bp, Homo sapiens
  misc_feature: GYAE6OF01BRW7K.24.76.G10.1.454.CMB.1.raw
  modified_base (462)..(462): a, c, t, g, unknown or other
  misc_feature (462)..(462): n is a, c, g, or t
  modified_base (508)..(508): a, c, t, g, unknown or other
  misc_feature (508)..(508): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactgggtccgccaggctccaggcaaggggctgggagtgggtgcagtttattgggttgatggaactaatgaatactatgcagagtccgtagaagggcgattcacatctcagagacaattccaggtagtaattttgtattcttcagtatagaacagtcctagagtagtcgagtacgacggntagtgtattacgtgtgcgatgaaagcgaaggaggtagtggttacgnggtgggtacg

SEQ ID NO: 6044 - DNA, 748 bp, Homo sapiens
  misc_feature: GYAE6OF01CS8C2.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagccgtggggacggtccctgagactgtcctgtgcagcgtctggacacatcttcaatacctatggcatgcacgtcggggtcccgccaggcctccgagggcgaagggggctgggagtggggtggctaggtttagttttgggtttagagttagggaaacttaagtagtaaattacgttaagtgacaaggtacggtcccggtaggaacggggtcccgtaattcccaacccgtacttccgtacccgaaggaacgtaacctaacgtttacccggaagggttaacgtttaaagttttttacggtaactttccgtttaaccgtaaggtaacttacggtaaaccgtacggttaacccgttaggaacgggtacgggttaaccgggaacggggtaaccctaccggggtaccttaacggtttacggttaaactttacggttggttacgggtacggtaaaggttaacgggaaaacggcgggaaagggggtaacgggttaacggtttaggggtttaaccgggaggggttagggggtaaccggg

SEQ ID NO: 6045 - DNA, 748 bp, Homo sapiens
  misc_feature: GYAE6OF01CW17L.24.76.G10.1.454.CMB.1.raw
  modified_base (305)..(305): a, c, t, g, unknown or other
  misc_feature (305)..(305): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctgggtggagtcgtgggggagcgtggtccagccgtggggacggtccctggagacctgtcctgtgcagcgtctggacacatcttacaatacctatggcatgccacgtgggtcccncgaggcctccgaggccgaagggggctgggagtggggtgctaggtttagttttgggtttagagttagggaaacttaaagtagtaaatttaacgtagtggaccgtaggtacggttacccggtaggaaaacggggcccttaatttacccgaaccctacgttcccgtacccgaaggaacgtaaccgtaaacttacccggaaagggttaacgttaaagttttttacggtaaactttacccgtttaacgtaaacggtaacgttaacgggaaaccgtaacggtacccttaagggaacgtacgggtaacgggaacgggtaacccgtacgggtaccgttaaagttacggttaaactttaccggttaggttacggtacggtaacgttaaagggaaaacggtacggaaaggggtaagggtagttagggggttacggtaggggttggggtaacgg

SEQ ID NO: 6046 - DNA, 761 bp, Homo sapiens
  misc_feature: GYAE6OF01DND6S.24.76.G10.1.454.CMB.1.raw
  modified_base (300)..(300): a, c, t, g, unknown or other
  misc_feature (300)..(300): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagccgtggggacggtccctgagactgtcctgtgcagcgtctggacacatcttacaatacctatggcatgcacgtgggtccnccgaggcctccgaggcgaaggggctgggagtggggtgctagtttagtttggtttcgagttaggaaacttaagtgtaaattacgtagttcgacgtaaggtacggttacccggtaagggaaaccggggtcccgttaaacgttttacccgaaccccgtaacgtttacccgttaaccccgaaaggggtaaacccgtaaacccgttaaaacgtttaccccggaaaaggggtttaacgtttaaaacggtttttttacggtaacttttacccgttttaacgaaacggttaacgtttaacggaaaaccgtacgtacccggttaaggaacgggtacgggttaccgggaaacgggtaaccgtaccgggtacttaagttagttaacgttacggttacgtcggtacgtaaggtaggaaaacggtcggaaaggggtaggtaaggtttaggggttacggtaggggtggggtaacg

SEQ ID NO: 6047 - DNA, 331 bp, Homo sapiens
  misc_feature: GYAE6OF01BFIV7.24.76.G10.1.454.CMB.1.raw
  modified_base (330)..(331): a, c, t, g, unknown or other
  misc_feature (330)..(331): n is a, c, g, or t
tcagactactatgtcacgaccggtgctcgatttagtcactcatacagggtgtacacctgtggttctcggggctgccctttggttttggagatggttttctcgatggggctgggaggcctttgttggagaccttgcacttgtactccttgccgttcagccagtcctggtgcacgacggtgaggacgctgaccacacggaacgtgctgttgaactgctcctcccgtggctttgtcttggcattatgcacctccgagagcacagcggccctgggctgcctggtcaaggactacttccacatagtagtctgagcgggctggcaaggcgcatagnn

SEQ ID NO: 6048 - DNA, 736 bp, Homo sapiens
  misc_feature: GYAE6OF01AK47K.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagccgtggggaggtccctgagactgtcctgtgcagcgtctggacacatcttacaattacctatggcatcgctacgtcggggtcccgccgaggcctccgagggccgaagggggctggggaggtggggtggtcgtaggttttagttttgggtttgagttagggaaacttaagtaggtaaattactagtgacgaaggtacggttcccggtaggaaacggggtcccgtaattcccgaaccctattccctaccgaagtaacgtaacctaacgttcccgaagggtaacgtttaaagtttttaggtaactttccgtttacgaagtaacttacggaaaccgtacgtacccgttaggaacggtaacgggttaccggaaagggtaacccgtaccgggtacgttaagttaggttaaacgtttaaccgttgggttacggtaccggtaaagttaacgggaaaacggtcggtaaagggggtaacgggttaaggtttagggggttaaccgggtaagggggttgggggtaacgg

SEQ ID NO: 6049 - DNA, 654 bp, Homo sapiens
  misc_feature: GYAE6OF01CGCPR.24.76.G10.1.454.CMB.1.raw
  modified_base (647)..(647): a, c, t, g, unknown or other
  misc_feature (647)..(647): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagcgtggtggagtcgtgggggaggcgtggtccagccgtggggacgtccctgagactgtcctgtgcagcgtctggacacatcttcaaatacctagtgcatgactacgtcgggtcccgccgaggcctaccgagggaccgaagggggctagggaggtggggtgacgtaggtttagttttggtttgaagttaggaaaacttaagtacggtaaattactaagtgactaggtacgtcccggtaaggaaacggggtccctaagttacccaaccgtacttaccgtaccgaacggaacgtaaccgtaaacgttaccgaaggtaacgttaaagtttttcgtaactttcgttacgaacgtaatacggaaacctacgtacctaggaagtacgtacggaacggaccgtacggtactagttacgttatacgtggtacgcgtaagtagaagacgaggtaggagtaggtacggnggtggag

SEQ ID NO: 6050 - DNA, 561 bp, Homo sapiens
  misc_feature: GYAE6OF01CK5HH.24.76.G10.1.454.CMB.1.raw
  modified_base (507)..(507): a, c, t, g, unknown or other
  misc_feature (507)..(507): n is a, c, g, or t
  modified_base (543)..(543): a, c, t, g, unknown or other
  misc_feature (543)..(543): n is a, c, g, or t
  modified_base (555)..(555): a, c, t, g, unknown or other
  misc_feature (555)..(555): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggtttttcctcgttgctcttttaagaggtgtccagtgtcaggtgcagctggtggagtctgggggagcgtggtccagcctggggaggtccctgagactgtcctgtgcagcgtctggacacatcttcaatacctatggcatgcacgtgggtcccgccaggcctccgaggccgaagggggctgggagtggggtgctaggtttatttggttgatagggaaacttaagtgtaatactatgcgagtacgtcagtaggaacgggtccgacgttccacctatcctaccgaagacgaacaattccgaagggtaacgttaattttgtacttcttacagtatagaacagcctagagaggtacgaaggacacggtntagtgtagttacgtgtgacgagtagaaagcgaaggnggagttgggtgnggtggg

SEQ ID NO: 6051 - DNA, 575 bp, Homo sapiens
  misc_feature: GYAE6OF01ETAUZ.24.76.G10.1.454.CMB.1.raw
  modified_base (295)..(295): a, c, t, g, unknown or other
  misc_feature (295)..(295): n is a, c, g, or t
  modified_base (471)..(471): a, c, t, g, unknown or other
  misc_feature (471)..(471): n is a, c, g, or t
  modified_base (532)..(532): a, c, t, g, unknown or other
  misc_feature (532)..(532): n is a, c, g, or t
  modified_base (564)..(564): a, c, t, g, unknown or other
  misc_feature (564)..(564): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagccgtgggaggtccctgagactgtcctgtgcagcgtctggacacatctcaatacctatgcatgcacgtgggtcccnccgaggcctccgaggccgaaggggctgggagtggggtggcgtaggtttattttgggtttgagttagggtaaacttaatagaaattactatgacagagtccggtgaaacgggccgaattcaccatctaccagagactaattccgaaggataattttgaacttcttacagtatgaacncgacctaggaagtacggtacgaaggaccgtacgggacttagtagttattaaccgtgtcganagtagaaagcgtagggagtacgttgggtacgngggtgggtaag

SEQ ID NO: 6052 - DNA, 523 bp, Homo sapiens
  misc_feature: GYAE6OF01C7CE0.24.76.G10.1.454.CMB.1.raw
  modified_base (261)..(261): a, c, t, g, unknown or other
  misc_feature (261)..(261): n is a, c, g, or t
  modified_base (325)..(325): a, c, t, g, unknown or other
  misc_feature (325)..(325): n is a, c, g, or t
  modified_base (350)..(350): a, c, t, g, unknown or other
  misc_feature (350)..(350): n is a, c, g, or t
  modified_base (455)..(455): a, c, t, g, unknown or other
  misc_feature (455)..(455): n is a, c, g, or t
  modified_base (478)..(478): a, c, t, g, unknown or other
  misc_feature (478)..(478): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctggggaggtccctgagactgtcctgtgcagcgtctggacncatcttcaatacctatggcatgcactgggtccgccaggctccaggcgaaggggctggagtgggngcagttattggttgatggaactaangaatactatgtcagtagtccggtagaacgggccgtattccaacccgattcctacccgaagacgactaattccgaggtacgtaattttgtatcttcagatgaacgngcctagagtcgtgaggtacacgntatgtattgtgtgagatagaaagcaggagattggtcgagtgggac

SEQ ID NO: 6053 - DNA, 619 bp, Homo sapiens
  misc_feature: GYAE6OF01A0TWD.24.76.G10.1.454.CMB.1.raw
  modified_base (500)..(500): a, c, t, g, unknown or other
  misc_feature (500)..(500): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgctcttttaagaggtgtccagtgtcaggtgcagctggtggagtcgtgggggaggcgtggtccagccgtggggacggtccctgagactgtcctgtgcagcgtctggacacatcttacaatacctatggcatgcacgtcgggtccgccgaggcctccgagggcgaagggggctgggaggtgggtggctagtttagtttggttgagttaggaaactaagtagtaaatacgtagtgacaggtacggtccggtaggaacgggtcctaattccacctactcctaccgaagtacgaactaacgttaccgaggtaacgttaattttcgatttccttacaagtatacgaacngtaccgtagaaggtacgtacggaaggtacacggtctagttacgtaacttcggtgtggtacgtaagtaacggaaacggtcgaagggtacgtaggttagggttacgggagggttgggtacg

SEQ ID NO: 6054 - DNA, 722 bp, Homo sapiens
  misc_feature: GYAE6OF01BQB5X.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggaggtccctgagactgtcctgtgcagcgtctggacacattcttcaatacctatggcatgccactgggtcccgccgaggcctccgagggccaagggggctgggaggtgggtggctagttagtttggtttgagttggaactaagttgaatactagtgacaggtacgttccgtggaacggggtcctaattccgacctacttcctaccgaaggtaacgaacctaaacgtttcccgaaagggtaacgttaaattttttggtaactttaccgtttacaggtaagttacgaaacgtaaggtaccctagggaacgggtaaggttaccggaacgggtaaccgtaaccggggtactttaacgttcggtttaaacgtttaaccggttcgggttaccgggtaaccggttaaggttaacccggggaaaaaaggtcccgggtaaaggggggttaacgggttaacggttttaggggggtttaaccgggttaaggggttcggggggtaaccgg

SEQ ID NO: 6055 - DNA, 727 bp, Homo sapiens
  misc_feature: GYAE6OF01B7ZV7.24.76.G10.1.454.CMB.1.raw
  modified_base (263)..(263): a, c, t, g, unknown or other
  misc_feature (263)..(263): n is a, c, g, or t
  modified_base (685)..(685): a, c, t, g, unknown or other
  misc_feature (685)..(685): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgctctttaagaggtgtccagtgtcaggtgcagctgggtggaggtcgtggggggaggcgtggtccagccgtggggaggtccctgacgtactgtcctgtgcagcgttntggacacatcttacaatacctatggcatgctacgtcggggtcccgaccacgggtcctaccggaggaccgggaaagggggcctaggggagggttgggggtcggtacgtaaggttttaggttttcgggttttaggaagtttacgggtaaaactttaaagtaggtaaaactttaacgtaagtcgtaacgtaaggtacggtaccggttaagggaacggggtaccctatttacccgaaccgtagtcccgtaccgaaaggaacgtaacttaacgtcccgtaaagggtaacgtttaaattttagtaacttccgtttagaaggttaataacggaaccgtacgtacccgttgggaaggtaacggtacggaacggtacggaaccggtacttaacgttaggttattaccgtggtagacgaaggtacggaaagnggaacgggtagggtagttacgggttaggagggttggggtacg

SEQ ID NO: 6056 - DNA, 647 bp, Homo sapiens
  misc_feature: GYAE6OF01BCJIZ.24.76.G10.1.454.CMB.1.raw
  modified_base (295)..(295): a, c, t, g, unknown or other
  misc_feature (295)..(295): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggaggtccctgagactgtcctgtgcagcatctggacacatcttcaatacctatggcatgcacgtgggtccnccaggctccgaggcgaaggggctgggagtgggtgctagtttatttggttgagtggaaactaagtgaaatacgtatgacaggacgtccggtaggaaacgggccgtaattccaacctattcccgtaccaaggaacgtaactaaacgttcccgaagggtaagttaaactttttgtaacttccgtttacgaagtactacgtaaacctacggtacccgttaggacgtaacgggttaccggaagggaaccgtacgggtaccttaagtcggttaaagtttacgtcggttaggaccgtaaaggtacggaaaagtcggtaaagggtacgggtaagttcggggttaccggtagggtacgggg

SEQ ID NO: 6057 - DNA, 554 bp, Homo sapiens
  misc_feature: GYAE6OF01ANSH6.24.76.G10.1.454.CMB.1.raw
  modified_base (469)..(469): a, c, t, g, unknown or other
  misc_feature (469)..(469): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactgggtccgccaggctccaggcaaggggctgggagtggggtggctaggtttatttgggtttgagttgggaaacttaatggtaaatactatggtacaggacgtccgtggaaacgggccgtaattccaaccgatctaccaagagactaattccgaggaagtaattttgtacttcttcagtatgaacngactagagagtcgaggacgacggctagtgtattacgtgtcgagatgaaagcgagggtaggtagtgggttacgaggttggggtacg

SEQ ID NO: 6058 - DNA, 574 bp, Homo sapiens
  misc_feature: GYAE6OF01C34RP.24.76.G10.1.454.CMB.1.raw
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
  modified_base (418)..(418): a, c, t, g, unknown or other
  misc_feature (418)..(418): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagcgtgggtggaggtcgtggggggaggtcggtggtcccaggccgtggggacggtccctggagactgtcctgtgcaggtcgtctggacacattctanaataccatggcatgcacgtcgggccncaggctccgaggcgaagggctgggaggtggtgctaggttntttggttnagtggaaactatagaatactntgacagacgtcgtaggagggctaatcacatctacaganactaactcgaagtagtaattttcgattactacagtatacgaacgacgacctggaacgagtacggaacggtaacacgggtactaacgtgtaacttacggtggtagagtaaggtgaaacggtagaagggagggtaagtagggttcgagggtggtacgg

SEQ ID NO: 6059 - DNA, 648 bp, Homo sapiens
  misc_feature: GYAE6OF01E40ET.24.76.G10.1.454.CMB.1.raw
  modified_base (302)..(302): a, c, t, g, unknown or other
  misc_feature (302)..(302): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctggggacggtccctgagactgtcctgtgcagcgtctggacacatcttacaatacctatggcatcgcacgtcggggtcccnccgaggcctccgaggcgaaggggctgggagtgggtgctagttgtttggttgagtaggaactaatgaattactagtgactaggtacggttccggtagggaacggggtcctaagttaccgaaccctagttccctaccgaaggtaacgaacctaacgttccgaaagggtaagttaaactttttgtaactttccttaacgaagtagtacgaacgtagtacccgttaggaacggtacggtacggaacggtaaccgacgggtacttaagttacgttaacgttacgttggtacgacgtaagtacggaaacgcgtaaggggtaggtaggttaggggtacgtagggtgggtacgg

SEQ ID NO: 6060 - DNA, 518 bp, Homo sapiens
  misc_feature: GYAE6OF01BTEYG.24.76.G10.1.454.CMB.1.raw
  modified_base (444)..(444): a, c, t, g, unknown or other
  misc_feature (444)..(444): n is a, c, g, or t
  modified_base (484)..(484): a, c, t, g, unknown or other
  misc_feature (484)..(484): n is a, c, g, or t
  modified_base (509)..(509): a, c, t, g, unknown or other
  misc_feature (509)..(509): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactggggtccgccaggctccgaggcaagggggctgggagtgggtggctagtttatttggtttgagtggaactaatgaatactatgcagagtccgtagaagggccattcaccatctcagagacaattccgaggtagtaattttgtatcttacagatagaacngcctgagtagtacgaggacacggctatgtattacgtgtgngatacgaagcgaggaggatggtcgnggtgggacg

SEQ ID NO: 6061 - DNA, 730 bp, Homo sapiens
  misc_feature: GYAE6OF01C40B5.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggctgaactgggttttcctcgttgcttcttttaaggaggtgtccagtgtcaggtgcagcgtgggtggagtcggtgggggaggtccggtgggtccaggccgtggggacggttccctggacgtacgtcggtcctggtcgcagggtcgtcgtaggaccacattccttacaattacctagtcggctatcgacgtacgtcgggtcccgccgtaaggccctccgaagggccggaaagggggtctggggacgggttcgggtagggtacgttaaggttttgtttgggtttagaagttacggtaaacttaagtagtaatactagtcgagtaaagtcggttaccgtaggaacgggtcctaacgttaccacgtacgtcctacgaagtacgtaacctaaggttaaccgaaggttaagttaacgttttacggtacttacgttaacgaacgtaagtaacgtaaccgtacggtaccgtaggaacggtacggtaacggacggtaacgaccggtaacgttagttgtttaaaccgtagttacggtagtacggtaaagacggaaaggtacggaagggttagggtacgttagggttacgggtaagggtcgggtacggg

SEQ ID NO: 6062 - DNA, 506 bp, Homo sapiens
  misc_feature: GYAE6OF01EDUPI.24.76.G10.1.454.CMB.1.raw
  modified_base (294)..(294): a, c, t, g, unknown or other
  misc_feature (294)..(294): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctctttaagaggtgtccagtgtcaggtgcagctggtggagtcgtgggggaggcgtggtccagcctgggaggtccctgagactgtcctgtgcagcgtctggacacatcttacaatacctatggcatgcactgggtccncaggcctcgaggcaaggggctgggagtgggtgctagtttattggttgatggaactaagtgaatactatgcagagtcgagaggcatcacntcncaganacatcagatattgatntcatatagacagctagagtagtcgagacacggtctagtgtatacgtgtgacgagtcgaaaagtcgaagggtaggtagttgggttacggaggtgggtacg

SEQ ID NO: 6063 - DNA, 604 bp, Homo sapiens
  misc_feature: GYAE6OF01AKNCO.24.76.G10.1.454.CMB.1.raw
  modified_base (303)..(303): a, c, t, g, unknown or other
  misc_feature (303)..(303): n is a, c, g, or t
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggagcgtggtccagccgtggggacgtccctgagactgtcctgtgcaggcgtctggacacgatcttcaattacctatggactatcgcacgtgggtccncaggcctccgaggcgaagggctggagtggngctagtttnttggttgagtggtaactaagtgaattactagtgactagacgttccggtagaaacggggtcctaattccaacctattcctacgagaacgactaacgttccgaagggtactattttacgattccgtacgaaggtaactggaaactcgtacctagggtagtacggtacggagtaccgaggtactaatggttaacttacgtgggtcgtagtagtaggaaacgtggaaagggtcgtaaggttagggttacggtagggtcgggtaacg

SEQ ID NO: 6064 - DNA, 636 bp, Homo sapiens
  misc_feature: GYAE6OF01EFYJK.24.76.G10.1.454.CMB.1.raw
  modified_base (261)..(261): a, c, t, g, unknown or other
  misc_feature (261)..(261): n is a, c, g, or t
  modified_base (623)..(623): a, c, t, g, unknown or other
  misc_feature (623)..(623): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggtttttcctcgttgcttcttttaagaggtgtccagtgtcaggtgcagctggtggagtcgtgggggaggcgtggtccaggcctgggacggtccctgagactgtcctgtgcagcgtcnggacacatcttcaatacctatgcatcgcaccgtgggtcccgcgaggcctccgaggcgaaggggctgggagtggggtgcgtagtttagttggttgacgtggaaactagtgaaattctatgacaggacgtccggtaggaacgggtcccgtattcaaccgtactctccgaagtacgaactaacgttaccgaagggtacgttaaagtttttcgtaatttccttacgtagtaacgttagaacacggaccgttagggagtaacgggtcggaacgggtacccgaggtccgttagttacgtttaacttaccgttgggtcggtacgtaagtacggaaacggtggaacgggtagggtagttggggttacggngggttgggtacgg

SEQ ID NO: 6065 - DNA, 692 bp, Homo sapiens
  misc_feature: GYAE6OF01EI0I8.24.76.G10.1.454.CMB.1.raw
  modified_base (298)..(298): a, c, t, g, unknown or other
  misc_feature (298)..(298): n is a, c, g, or t
  modified_base (584)..(584): a, c, t, g, unknown or other
  misc_feature (584)..(584): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagccgtggggagtccctgagactgtcctgtgcagcgtctggacacatcttcaatacctatggcatgcacgtcggggtccnccgagggcctccgagggcgaagggggctagggaggtggggtggctaggtttagttttgggtttgagttagggaaacttaatggtaaatactagtgactaggacggttccggtaggaacggggtccgtaatttccaaccctattccctaccgaaggtaacgaaacctaacgttacccgaaagggtaagtttaaagttttttacggtaactttaccgtttacgtaagtacttacgaaactacggtaccgtagggaagtaacgggtacggaacgggtaccgaaccggtnttaacgttcgttaacgttaccgttggtacggtaccggtaagttacggaaaacggtcggaaaggggtaggtaacggtttaggggttacggtaaggggttggggtaacgg

SEQ ID NO: 6066 - DNA, 655 bp, Homo sapiens
  misc_feature: GYAE6OF01BXISB.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggaggtccctgagactgtcctgtgcagcgtctggacacattcttcaataccctatggcatgcacgtgggtccgccaggcctccgaggcgaaggggctgggaggtgggtggactaggtttagtttgggtttagagtgggtaaacttaagtagaaattacgtatgacagacgttccggtaggaacgggcctattaccgacctactcctaccgagacgaacgtaacgttcccgaagggtaacgttaagtttttgtactttcgttaccagtactagaactacggtacctaggaacggtacggtacggaacgggaaccgacgggtactaaggttagttacgttaacgttggtacggtacggtaaagttacggaaaacggtcggtaaaggggtaacgggttagtttacggggttacggtagggttgggggtaaccgg

SEQ ID NO: 6067 - DNA, 783 bp, Homo sapiens
  misc_feature: GYAE6OF01CH9NA.24.76.G10.1.454.CMB.1.raw
tcagactactatgtcacgaccggtgctcgatttagtcactcatacgagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagctggtggagtcgtggggagcgtggtccagccgtgggacggtccctgagactgtcctgtgcagcgtcgtaggacactatcttacaatacctagtggcagtcgcctacgtcgggtcccgccgaggccctaccgaggaccggaaggggcctaggggagggttggggtcggtacgttaagggttttagttttgggtttagaagttaggtaaacgttaagtagtaaattaacgtagtcgacgaagtacggtccggtaaggaaccgggtcctattacccaacctatacccgtaccgaacggtaacgtaaaccgtaacgttacccggaaagggttaagtttaacgtttttaggtaaccttttaccgtttaacgaacgttaacgtaaccggtaaaccgtccgggttaacccgttaggtaacgggtaacggttaaccgggaacgggtaaccgtacccggggttaactttaacgggttaacggtttaaaccgttttaacggtaccgggttacggtaaacccggttaagtaaacgggaaacggtaccgggtaaggggtaacggttaagggttacggggttacggtaaggggtcggggtaacg

SEQ ID NO: 6068 - DNA, 763 bp, Homo sapiens
  misc_feature: GYAE6OF01CLK3P.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagccgtggggaggtccctgagactgtcctgtgcagcgtctggacacatcttacaatacctatggcatgcacgtgggtcccgccaggcctccgaggccaagggggctgggagtgggtggctaggtttagttttgggttgagttggaaacttaagtagtaatactagtgacaggtacgttccggtagggaaacggggtcccgtaattccgaaccctaacttccgtacccgaaaggtaacggaacctaaaacgtttcccgaaaggggttaacttaaagtttttttcggtaaactttccgttttacgaacggtaagtttaacggaaaaccgtacggtacccgttagggaaacggtacgggttaccgggaaacgggtaacccggtacgggtacctttaaaggtttacggtttaaacgttttaaccggtacgggttacggtaccgggttaaagttaacgggaaaaacgggtacgggttaaaggggggtaaaacgggttaagggttttagggggtttaacccgggaaagggggtttacggggggttaaacgg

SEQ ID NO: 6069 - DNA, 794 bp, Homo sapiens
  misc_feature: GYAE6OF01CZNO8.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttctttaagaggtgtccagtgtcaggtgcagcgtgggtggaggtcggtggggggacggcggtgggtaccaggccgtgggggacggtcccgtggagtctcggtcctgtgccgagtcgtcgtggacacattcttacaaactacctagtcggacagtcggaccgtacgttcggggtccccgaccgacgggtcctaccggaggaccggaagggggtcctaggggacgggttggggcggtacttaggttttaggtttgggtttagaacgttagggtaaacttaagtaggtaataacgtagtcgacgtaggtacggttaccggtaaggaaccgggtccgttacttacccgaaccgtacgttcccgtaccgaaggtaacgtaaacctaacgttacccggaaagggttaacgttttaagtttttacggtaacctttacgttaacgaagggttaacgtacggtaaaacctcggtacccggtaagggaacggttaccgggtacgaacgtaccggacggttactttaaggttacgttaaacgtttacggtcgggttacggaacggtaaggttaacgggaaaaccgggtcggtaaaaggggggtctttaacggggtggggttaacggtaggggggtacgggtaaccg

SEQ ID NO: 6070 - DNA, 562 bp, Homo sapiens
  misc_feature: GYAE6OF01CYK7P.24.76.G10.1.454.CMB.1.raw
  modified_base (474)..(474): a, c, t, g, unknown or other
  misc_feature (474)..(474): n is a, c, g, or t
  modified_base (518)..(518): a, c, t, g, unknown or other
  misc_feature (518)..(518): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggttgtccagtgtcaggtgcagctggtggagtcgtgggggaggcgtggtccagccctggggaggtcccctgagactgtcctgtgcagcgtctggacacatcttcaatacctatggcatgcacgtcgggtcccgccaggcctccgagggccgaagggggctgggagtggggtgctaggtttatttggttagagtggaaactagtagtaatactatgacagtacgtccgtaggacgggccattccgaccactcctaccagacgacaattaccgaaggtagtaattttgattcgttacagatagaacncgcctaggagtagtacggagacaggtctagtgtattcgtgtcgngtaagtgaaaggcgaggaggtagtgggttacgagggtgggtacg

SEQ ID NO: 6071 - DNA, 664 bp, Homo sapiens
  misc_feature: GYAE6OF01ACFHU.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagccgtggggacggtccctggagacgtgtcctggtgccaggtcgtctggaccacgtattcttacgaaatacctatggactagtcgcctacgtcggggtcccgccgtacggcctccgaggcggaacggggctagggaggtgggtacgacgttagtttacgttggttagagtaggaaacttagtagtaactacgtagtgactaggtacgttaccggaggtaaacgggccttaactccaaccgtacttcccgtaacgaagacgtaaactacgttaccgaaggtaacgtttaacgtttgtacgttacttacggaaagttacgtaacgaaccgtgtaccgtaggaagtcggaacgacgggacgtagtaactagtacgttagtccgttggtacgtagtaacgaaggaacggacgtaagggtacgttaggttcggggagtgggtcggtacgg

SEQ ID NO: 6072 - DNA, 645 bp, Homo sapiens
  misc_feature: GYAE6OF01DJ764.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctggggagtccctgagactgtcctgtgcagcgtctggacacatcttacaatacctatggcatgcacgtgggtcccgccaggcctccgagggccgaagggggctgggaggtgggtggactagttttagtttggtttgaagttaggaaacttaagtagtaaattacgtagtcgacgtagtacgtccggtagaaacggggtcccgtaattccaaccgacttccgtaccgaagacgtaacctaagttaccgaagggtaacgttaagtttttcgtaacttctttaacgaaggtactacgaacgtacgacccgttaggaaggtacgtacggtaacggaacgtacgggacttaagtagttacgttaccgtgttacggacgtaagtaggaaaagcggaaggtaggtaagttgggtacgtagggtgggtaacg

SEQ ID NO: 6073 - DNA, 832 bp, Homo sapiens
  misc_feature: GYAE6OF01BGMRE.24.76.G10.1.454.CMB.1.raw
  modified_base (266)..(266): a, c, t, g, unknown or other
  misc_feature (266)..(266): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagcgtgggtggagtcgtggggggagcgtggtccaggccgtggggacgtccctgagactgtcctgtgcagtcgtcgnggacactattcttacaattccctagtcggactatcggacctacggtcggggtccccgaccgagggccctaccggagggaccggaagggggtctaggggaggtcgggtaggcttaggttttaggttttggttaggagttaagggtaaacctttaagtagtaaaattacgttagtgtaacgaggtacggttccggtaagggaaccgggtcccgtaagttacccgaaccttacttacccgtaccgaaaggaaccgtaaaccgttaaccgttaccggaaacgggttaagtttaacgtttttagtaaccttttaccgttaagaaacggttacgtaaccggtaaaccgtaccggttaccgtaagggtaaccgggttaacgggtaaccggtaaaccggggtaacccggtaaccggttacgtttaagtttaacgggtttaacgtttaacccggtagggttagggtaacccgttaaagggtaaacgggaaaacccgggtagggaaacgggggtttaaggggttaccggtttaagggggtttacccgggtaaggggggttaggggttaaacccggg

SEQ ID NO: 6074 - DNA, 745 bp, Homo sapiens
  misc_feature: GYAE6OF01DK1TW.24.76.G10.1.454.CMB.1.raw
  modified_base (260)..(260): a, c, t, g, unknown or other
  misc_feature (260)..(260): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaactgggttttcctcgttgccttcttttaagaggcgtccagtgtcaggtgcagctggtggagtcgtgggggagcgtggtccagccgtggggacgtccctgagctgtcctgtgcagcgtcgnggacacatcttacaaattaccctagtcggacattgccgtacgttcgggggtccccaccgtaggcctaccggagggaccggaaggggcctggggtacggttggggtggactaggtttagtttggtttagacgttaggaacttaaagtgtaaacttacgtaatgcgaggtagtacccggtaggaaaccgggccgttaatttcccaaccctacttaccgttacccgaaggtaacgtaacctaacgtttacccggaagggttaaacgtttaaagttttttacggtaactttaccgtttaaccgtaagtaacgttaacgaaactaccggtacccgttaggtaacggtaacggttaccgggaaacggtaccggtaccggtactttaaggttacgttaacgttttacgtcgggtaacgtacggtaaggttaacggaaacggtcggaaggggtaaggttaaggttacggggtttacggagggtttcgggacgg

SEQ ID NO: 6075 - DNA, 730 bp, Homo sapiens
  misc_feature: GYAE6OF01DFZKQ.24.76.G10.1.454.CMB.1.raw
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
tcagactactatgtcacgaccggtgctcgatttagtcactcatacagggggggagaggagcccagcactagaagtcggcggtgtttccattcggtgatcagcactgaacacagaggactcaccagtggagtttggcctgaacttgggttttcctcgttgcttacttttaagaggtgtccagtgtcaggtgcagcgtgggtggtagtcggtgggggacgtcgtgggtaccaggccgtggggacgtccctgacgtctgtcctgtgcagcgtctggacacattcttacaactcctagtggacagtcgactacgtcgggtcccncncggtcctacggaggcggaagggtcgtagggaggtgggtcggacgtaggttttgtttaggttagtagtaggtaaacttaagtacggtaaatacgtagtacggtaccgtaaggtaccggttaccggtaagggtaaaccgggtcccgttaacgttacccgaacccgttacgttacccgttaacgaacggtaaacgtaacctaaacggtttaccgtaagggttaactttagttttacgtacttaccgtttaacgaagttataaccgaacgtcgtaacccgtaagacgggtacgtaccggaacggacgtacgttacgttagtacggttagttaccgtaggtacgtaccgaagttaaccggaaagtcgggtaagggtaacggttacgttgggtaccgggtagggtcggttaacg

SEQ ID NO: 6076 - DNA, 880 bp, Homo sapiens
  misc_feature: GYAE6OF01D2QQW.24.76.G10.1.454.CMB.1.raw
  modified_base (862)..(862): a, c, t, g, unknown or other
  misc_feature (862)..(862): n is a, c, g, or t
tcagactactatgtcacgaccggtgctcgatttagtcactcatacgagggggggagaggagcccagcactagaagtcggcggtgtttccattcggtgatcagcactgaacacagaggactcaccagtggtaggtttggcctgaacttgggttttcctcgttgcttacgttttaaggaggttcgtcctagtgtcgaggtgcgagcgtgggtggaggtcggtggggggaggtcggtcggtccaggccggtggggacggtccctggtacgtacgttgtccgtggtacgcgacggtcgtcgtacggaacctactattaccttacaaacttaacccgtagtgggactacgtcggacccgtacgggttccgggtccccggaccgtacgggtcccgtacccgggaaggggaccgggtaacgggggtccgtagggggtagggtttgggggtaccgggttacggtttaagggtttttaggtttttggggttaaggtaaggttaacggtaaaacgttaaagtaacgtaaaacgttacgtaagtacggtaccgaaaggtacggtaccgggtagggtaaaccgggtccgtacttaccgaacccttcgtacccgtaacgaaggtaaaccgtaactaacggttaccgtaaagggttaaattttacgtttttagtaaccttacggttaaccgtaaggttaacgtaacggaacgtaaccgttcggtaacggtaacgggtaacggttaccgggaaacggacgtaccgggtaactttaacgggttaacgttacgtttaaacggtcgggtaccgtaaaggttaacggttaaaagggacccgtaaggtaaagggtacggtttagggttaacggggttacggnggggtagggttaacccgg

SEQ ID NO: 6077 - DNA, 586 bp, Homo sapiens
  misc_feature: GYAE6OF01DN9MS.24.76.G10.1.454.CMB.1.raw
  modified_base (486)..(486): a, c, t, g, unknown or other
  misc_feature (486)..(486): n is a, c, g, or t
  modified_base (497)..(497): a, c, t, g, unknown or other
  misc_feature (497)..(497): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggagcgtggtccagcctgggaggtccctgagactgtcctgtgcagcgtctggacacatcttcaatacctatggcatgcacgtgggtccgccgagggcctccgaggccgaagggggtctgggaggtggggtggctaaggtttagttttgggtttagacgttaggtaaacttaagtgaaattacgtagtgacaggtagtccggtaggaacgggccgtattccaacctatcctaccgaagtacgaactaacttaccgaaggtacgtaattttgtacttcgttanagtatagaacngtcctagagtagtcgaggacgcggactagtgtacttacgtggtgagtatacggaagcgaaggtaggagttgggtacgagggtgggtacg

SEQ ID NO: 6078 - DNA, 873 bp, Homo sapiens
  misc_feature: GYAE6OF01B6PM7.24.76.G10.1.454.CMB.1.raw
tcagactactatgtcacgaccggtgctcgatttagtcactcatacagggggggagaggagcccagcactagaagtcggcggtgtttccattcggtgatcagcactggacacagaggactcaccatggagtttggcctgaacttgggttttcctcgttgcttcttttaagaggtgtccagtgtcaggtgcagctgggtggagtcgtgggggaggcgtggccaggccgtggggacgtccctgagctgtcctgtcgcagcgtcgtggacacgtattccttacaaacttacctagtcgggctaattcggacctaccggtccgggggtaccccgcccgtaaggggtccctaccggaaggggaccggaaaggggggtccgtagggggtaacggggttcgggggtacgggtaccgttaagggttttaacggttttttggggttttacggaaaggttacggggtaaaaacttaaaggttacggtaaaacgtttaccgttaagtcggaaccggtaagggtaccgggttacccgggtaagggaaaccggggtaccccgttaatttacccccaaaccgttacgttacccgtaaccggaacggttaaaccggaaacctttaaacggttacccggaaaggggttaaccttttaaagtttttcggtaacctttacgttacgaaacggttaacttaccggaaacgttccgtaccgttaagggaacggttaacggggaaccggtaagggaaccgtacgggttactttaaggttacggtttaagttaacccggtggttacggtaaccgtaaaggtaacggaaaaccgggttcgggaaaggggttaacggtacggggtttaggggtaaccgggtaaggggttcgggtacgg

SEQ ID NO: 6079 - DNA, 711 bp, Homo sapiens
  misc_feature: GYAE6OF01CLJMX.24.76.G10.1.454.CMB.1.raw
  modified_base (567)..(567): a, c, t, g, unknown or other
  misc_feature (567)..(567): n is a, c, g, or t
tcagactactatgtcacgaccggtgctcgatttagtcactcatacgaggggggggagaggagcccagcactagaagtcggcggtgtttccattcggtgatcagcactgaacacagaggactcaccatggagtttgcctgaacttgggttttcctgttgcttcttttaagaggtgtccagtgtcaggtgcagcgtgggtggaggtcggtggggggaggcggtggtccaggtccgtggggacggttcccgtggagtacttgtcctggtgcaggcgtcaggacacattcttacaactacctagtcggcagtcgctacggttcgggtccccgaccgacgggccctaccgggagggacggaacgggggtcgtggggagggttggggtacggtcgtttaagggtttttagttttgggtttacggaagttacgggtaaaacttaaggtaagtaaactacgtagtacgacgtagggtacggtaccggtaggaaccgggtctacttaccaccgtataccgtacgagtacaactagtaccgaggtaatttatttgtatcttacgatagttacgaacncgtacgtaggaacgtacggtaccgaaggacggtcggtaaccttggttaacgttacgtttgacgggtacaagggttagaaacggaaacggacggtaagggggttaggttacgggttacgggtaggggtaaggttcggggtaaccg

SEQ ID NO: 6080 - DNA, 632 bp, Homo sapiens
  misc_feature: GYAE6OF01C5CQN.24.76.G10.1.454.CMB.1.raw
  modified_base (305)..(305): a, c, t, g, unknown or other
  misc_feature (305)..(305): n is a, c, g, or t
  modified_base (333)..(333): a, c, t, g, unknown or other
  misc_feature (333)..(333): n is a, c, g, or t
  modified_base (372)..(372): a, c, t, g, unknown or other
  misc_feature (372)..(372): n is a, c, g, or t
  modified_base (621)..(621): a, c, t, g, unknown or other
  misc_feature (621)..(621): n is a, c, g, or t
tcagactactatgtcacgaccggtgctcgatttagtcactcatacagggggggagaggagcccagcactagaagtcggcggtgtttccattcggtgatcagcactgaacacagagactcacatggagttgcctgaactgggtttcctcgttgctctttaagaggtgtccagtgtcaggtgcagctggtggagtcgtggggggagcgtgggtccaggccgtggggaggtccctggagactggtcctggtgcagcgtctggacacatcttacaatacctatggcatgcacgtcgggccaccaggtcnccgaggctaaggggctgggaggtggggngcgtagtttagtttgggtttgaagtacggaaaacttaanggtaaaattaactatcggacaaggtacggttccgaggaaacggggccctattacgaacctattccaccgaagtacggaaactaattccgaaagggtaagttaatttttgtaacttcttaacgagtaagtaggaaacctagaccgtgaagggagttacccggaaggaaccgtacgggtcttaagtacggttattaagtggttggacggattaagggaaacgcgaaggggtacggagttaggggttaccgnggtggggaccg

SEQ ID NO: 6081 - DNA, 756 bp, Homo sapiens
  misc_feature: GYAE6OF01DQYWD.24.76.G10.1.454.CMB.1.raw
  modified_base (345)..(345): a, c, t, g, unknown or other
  misc_feature (345)..(345): n is a, c, g, or t
  modified_base (665)..(665): a, c, t, g, unknown or other
  misc_feature (665)..(665): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaacttgggttttcctcgttgtcttcgttttaaggaggtgtccagttgtcgaggtgcagtcgtgggtggaggtcgtggggggagcggttcggtccaggtccgtggggacggttccctggagtactcgtccgtgtcgcaggtcgtcgtggaccactacttccttacaaagtcctagtggactagtcgacctacggtcggggtaccccncgtacggtccctaccggaaggggtcccgaagggggtctagggggtaggttcgggggtaggtaccgtttaggtttttaggttttcggggtttagaacggtttaacggtaaacttaaagtgtaaaagttacttaggtcgacgtaaggtaccggttaccggaggaaacgggtccctaagttccgaaccgtagttccgtaaccgtaagtaaccgtaacgtaacgttaccgaaggttaagtttaacgtttttagtacgttacgttacgaagtacgtacgaacgtacgtaccgtaggaggtacggtacgaacggtacgtaccggtnttaacgtagttaaccgttagttaggtacgaggtaaacgtaggaacgaaggtagggtacggttacggttagggtacggtaggttgggtaccg

SEQ ID NO: 6082 - DNA, 691 bp, Homo sapiens
  misc_feature: GYAE6OF01CENMM.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagctggtggagtcgtgggggagcgtggtccaggccgtggggacgtccctgagactgtcctgtgcagcgtctggacacatcttacaattacctatggcagtgcacgtcgggtcccgccaggcctccgagggccgaaggggtctagggaggtggggtcgcgtaggttttagttttgggtttagagttagggaaacttaagtagtaaattactagtcgacgtaggtacgtccggtaggaacgggtccgtattccaccctattcctaccgaaggaacgtaactaacgttacccgtaagggtaacgtttaaagtttttacgtactttaccgtttacgaaggttacgttaacgaaccgtacggtacccgtagggaacgggtacgggtaccggaacgggtaacccgtacggttacttaaggttagttaacgttacgtggtacgagtaacgtaggaaacggtcggtaagggtaacggttaggttagggttacggaggggttcgggtaacg

SEQ ID NO: 6083 - DNA, 663 bp, Homo sapiens
  misc_feature: GYAE6OF01AXE6W.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctgggtggagtcgtgggggaggcggtggtccaggccgtggggacggtccctgagactggtcctgtgcagcgtcgtggacacattcttacaattacctatcggcatgcacgtgggtcccgcgaggcctaccgaggcgaaggggctgggaggtggggcggtctagtttagttttggttgacgtaggtaaactaagtagaaatactagtgacaggtacggttccggtaagaacggggccctattaccacctactcctaccgagacgaactaacgttaccgaagggtaagtttaagtttttacggtactttactttacgaagttacgtaacgaacgtacgtaccgtaggaacgtacggttacggaacggaaccgtacggtacttagtacgttagttaccgttggtacggtagtaacgtaagggaacgtacgggaagggtaaggaggttagggttacggtaagggttcggggtaacggg

SEQ ID NO: 6084 - DNA, 678 bp, Homo sapiens
  misc_feature: GYAE6OF01BWX1W.24.76.G10.1.454.CMB.1.raw
  modified_base (248)..(248): a, c, t, g, unknown or other
  misc_feature (248)..(248): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagcctggggagtccctgagactgtcctgngcagcgtctggacactatctacaatacctagtggcagtcgctacgtcgggtcccgccgaggcctccgaagggcgaacgggggtctaggggacggtggggtggtctaggttttagttttgggtttaggagttaggtaaactaagttagaaattacgtagtgacgagtacgtccggtaggaacgggcctattcaccctatccgtacgagaacgtactaacgttccgaaggtacttaagttttaggttacttcgttacaaggtacgttacgaacgtacgaccgttaggaacgtacggtacggaacgaaccggaaccggtacttaagttacgttaacgtttaaccgtggtacgtacgggtaacgtagggtaaaacggtccggtaaaggggtaggtacgggtttaggggtaccggtaggggtcggggtaaaccgg

SEQ ID NO: 6085 - DNA, 635 bp, Homo sapiens
  misc_feature: GYAE6OF01AWLSC.24.76.G10.1.454.CMB.1.raw
  modified_base (306)..(306): a, c, t, g, unknown or other
  misc_feature (306)..(306): n is a, c, g, or t
  modified_base (593)..(593): a, c, t, g, unknown or other
  misc_feature (593)..(593): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctggggacggtccctgagactgtcctgtgcagcgtctggacacatcttacaattacctatcggctatcgctacggtcgggtcccnccgaggcctccgaggccgaaggggctagggaggtgggtggctaggtttagtttgggttgagtacggtaactaagtacgtaatacgtagtcgacgtaggtacgtccggtaggaacgggtcctagttaccaccgtactccctacgaagaacgtaacaagttaccgaagggtattaacttttggactttacctagagtactacgtaacgagtccgaaggaggtaacggtacggaacggacgacggtacttagtacgttactacgtaggtacgtacgaaggttagaacggngtaacgggtaggtacggttagggtacgtagggtcggggtacg

SEQ ID NO: 6086 - DNA, 739 bp, Homo sapiens
  misc_feature: GYAE6OF01BAUSO.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggtctgaactgggttttcctcgttgctcttttaagaggtgtccagtgtcaggtgcagctggtggagtcgtgggggaggcgtggtccagcctggggagtccctgagactgtcctgtgcagcgtctggacacatcttcaatacctagtggcatcgcacttcggggtcccgccaggcctaccgagggccaagggggccttaggggacgttggggtcggctaaggtttacttttgggtttgaagtggtaaacttaaagtggtaaactacgtagttcggactaaggacggttcccggtaggaaaccgggggccctaagttacccgtaaccctaagttccgtaaccccgaaggaacccggtaaacctaacgtttacccggtaaaggttaacggttaaattttttcggtaactttaccgtttaccgaaaggttactaacgggaaacctcggacccttagggaacgtaagggttcggaaacggaaccggttacgggtacgttaacgttaggtttaccgtttaaccggttggtaacggtaccggttaaggtaacgggtaaacgcggtaaacggggtaggacggtttacgggttaccgggtagggtaggggtaaccg

SEQ ID NO: 6087 - DNA, 699 bp, Homo sapiens
  misc_feature: GYAE6OF01C6R57.24.76.G10.1.454.CMB.1.raw
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctgggtggagtcgtgggggagcgtggtccagccgtgggacgtccctgagctgtcctgtgcagcgtcnggacacatcttacaatacctatggcatcgcacgtcgggtccnccgagggtcctaccgagggacgaaaggggggtctaggggtacggttgggggtgtacgttaagggttttagttttgggtttagaagtttacggaaaacttaagtagtaaacgttactagtacggacgaaggttacgggtaccggttaagggaaacgggtccttataccgacctagttaccgtaccgaaggtaacgtaacctaaacgttacccggaaggttaacgtttaagttttacgtacttacgtttacaagtaagttaccgaaacgtacggaccgttagggaacgtcggtaacggacggtaaccgacggtacttagttagttacgttacgtaggtacgacgtagtaacggaaaggtacggagggtaacggtaggttaggtacgggaggttggggtaacg

SEQ ID NO: 6088 - DNA, 735 bp, Homo sapiens
  misc_feature: GYAE6OF01EQJRE.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcggtggtccagccgtgggacgtccctgagctgtcctgtgcagcgtctggacactatcttacaactacctatggctatcgctacgtcgggtcccgccgaggtcctaccgagggccgaagggggtctaggggtaggtggggtgtacgttaggttttagttttcgggttagaagttacgggtaaacttaagtaggtaaattacgttagtgacgtaaggtacgttccggtaaggaaccggggtacctacttacccgaacctacgttacccgtaccgaaggtaaccgtaaacctaacggtttacccggaaagggttaaacgtttaacgtttttacggtaactttacgttaccgaagttacgtaacgaaccgtcgtaccgtaggacgtaacggtacggaacggtaccgtacggtacttagttacggttacttacggttcggtacggtacgttaaggtaacggtaaacgggtacggtaaggggtacgggttacggttaggggttaaccgggtggggtaggggttaacccgg

SEQ ID NO: 6089 - DNA, 625 bp, Homo sapiens
  misc_feature: GYAE6OF01DPP9E.24.76.G10.1.454.CMB.1.raw
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
  modified_base (601)..(601): a, c, t, g, unknown or other
  misc_feature (601)..(601): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctagaacttgggttttcctcgttgcttcttttaaggaggtgtccagtgtcgaggtgcagctgggtaggagtcggtgggggagcggttggccaggcctggggacgtccngagctgtctngcagcgtcnggaccatactcttacaattacctagtcggcatcggccacggttcgggaccccacgacggtcctaaccgagggaccgaagggggtctacggggtagggtcgggtgtaccttaaggttttagtttgggtttacgaagtaggaaacttaagaggtaaaatctaagtcgacgagcggtacgtagagggtacactcaccgtatccgacaagacgaactaacttaccgaggttaacgttaatttgtacttacttagaagtatacaagtacgacgttaggagttacgacggtaacgacgacgtacttagtagtatacgtggacgagaagtacgtaagcgaggganacggttggttacggaggtggtacg

SEQ ID NO: 6090 - DNA, 669 bp, Homo sapiens
  misc_feature: GYAE6OF01E2XZJ.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctggggaggtccctgagactgtcctgtgcagcgtctggacacatcttcaatacctatcggcatgccacgtgggtcccgcgaggcctccgaggccaaggggctggaggtgggtggctagtttagtttggttgagttggaactaagtgaattactatcgctagacgttccgtaggaacggggccctattccgaccctattcctaccgaagacgtaacctaacgttaccgaagggtacgttaagtttttcggtaactttccgtttacaaggtaactacggaacctaacggtacccgttaggaacggtaacggttaccggaagggtaaccgtaaccgggtcttaagttagtttaaacgttaccgttgggttaccggtacggtaagtagggaaaacgggtccgaaaggggtaacggtaggttagggttacgggtaaggggttcggggtaacgg

SEQ ID NO: 6091 - DNA, 616 bp, Homo sapiens
  misc_feature: GYAE6OF01ASYUD.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccaggcctggggaggtccctgagactgtcctgtgcagcgtctggacacatcttcaatacctatggcatcgcacgtggggtcccgccaggcctccgagggccgaagggggcctggggaggtggggtggtctaggtttagttttgggtttgagtggaaacttaagtgtaaatactatggacaggtacgtccggtaggaacgggtcctaagttccacctagtcctaccgagtaacgactaacgttccgaaggtagttaagttttgtacttcttacgagtatacgaacacgtaccgtaggagtacggtacggaacggaccgacggtacttagtagttacttacgtggtcgtacgagtagaaacggtcggagggtaggtagttagggttacggagggtgggtacg

SEQ ID NO: 6092 - DNA, 769 bp, Homo sapiens
  misc_feature: GYAE6OF01BZLJ5.24.76.G10.1.454.CMB.1.raw
  modified_base (754)..(754): a, c, t, g, unknown or other
  misc_feature (754)..(754): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttgcctgaacttgggttttcctcgttgcttcgttttaagaggttgtccagtgtcgaggtgcagtctgggtggagtcggtgggggaggtcgtgggtccaggtccgtggggacggtccctggaacgtcttcgtccgtggtcgcaggtccgttcgtcggaactactattcctttaccaaattacctagtcggactatcggtcctacggtcgggtccccgtacggacggtcctaccggaagggaccggaagggggtcgtaggggagggttcgggggtacggtacgttagggttttaggttttgggttagtacgttaaggtaaacttaaggtagtaaactagtagtaggacgtaaggtacgttccggaaggtacgggtaccttattaccgtaacctacgttccgtacccgaaagtaccgtaaacgtaaccgttacggtaaaggttaaccgtttaagtttttaacggtaactttaccgttacaaaggttaccgtaaggtaacccgtaagtacccggtaggtaacggtacgggttacggaaccgggtacgacggttaacgttagttacttaagttacgtcggtagtaacgtagtaaacgggaacgtgaacggtaggtacggttggtaaggnggggttacggtacgg

SEQ ID NO: 6093 - DNA, 757 bp, Homo sapiens
  misc_feature: GYAE6OF01EXGEH.24.76.G10.1.454.CMB.1.raw
  modified_base (188)..(188): a, c, t, g, unknown or other
  misc_feature (188)..(188): n is a, c, g, or t
  modified_base (582)..(582): a, c, t, g, unknown or other
  misc_feature (582)..(582): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtncagctgggtggagtcgtgggggagcgtggtccaggccgtgggacgtccctgagactgtcctgtcgcagcgtcgtggaacactacttcttacaacttacctagcggcaagttcgacctacggttcggggtccccaccgacgggtcctaccgaaggggccggaacgggggtctgggaacgggttggggtacggcgttaaggttttacgttttgggttagaagttacgggtaaaacttaagtaaggtaaatttcgtaatcggacgtacgggtacgttccggtaaagggaaccgggtccctaagttacccgaacccgttactacccgttaccgaaagtacgttaaacctaacggttaccgaaaggttaacgtttaagttttagttactttaccgttanaaacgttacgtaacgtaaaccggtacgtaccgtaaggtaacgggtaacgttaccgggaagtaacccgtacgggttaacttaggttacggttaactttacgtaagggtcctaagggaagttaacgggaaagtacggaagggtaggttaacggttgggttacgaagggtcgggtacg

SEQ ID NO: 6094 - DNA, 644 bp, Homo sapiens
  misc_feature: GYAE6OF01CK1DM.24.76.G10.1.454.CMB.1.raw
  modified_base (434)..(434): a, c, t, g, unknown or other
  misc_feature (434)..(434): n is a, c, g, or t
  modified_base (488)..(488): a, c, t, g, unknown or other
  misc_feature (488)..(488): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagcgtggtggagtcgtgggggaggcgtggtccagccgtgggacggtccctgagctgtcctgtgcagcgtctggactcacttctacaatacctatggacatgccgacgtcgggtccgccgaggcctccggaggcgaggggctgggaggtgggtgacgtagtttgtttggttagagtaggtaactagtagtaactatagtgacgaggtacgtaccggtaggaacgggtcctattccaacctactaccnctaagacgaataacgtacgaggtattaatttcgattctcgaatactacgaacgngtacgtggacgtaggtaacgaggaccgtacggtacttaagtacgtttaacgttacgttacgggtcggtacggttaaggtaacgggaaaaggacgggtaaaggggtaccggggttaagtttaccgggggtacgggtaaggggtttcggggtaaacgg

SEQ ID NO: 6095 - DNA, 835 bp, Homo sapiens
  misc_feature: GYAE6OF01D9EPS.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaacgttgggttttcctcgttgcttcgttttaagaggtgtccagtgtcaggtgcagtcgtggtggagtcgtgggggagcggtggtccaggccgtggggacgtccctgagtactgtcctgtcgcaggtcgtcgtggaacctacattccttacaaacttacccgttagtcggacctagttcgcctacgttcggggtccccgccgacggtcctccggaaggtccgaaggggtcgtgggacggtggggtgtcgttaaggttttagttttgggttagaagttacgggtaaaacttaagtagtaaaactttacgtaagtcggacgtaagggtacggttcccggaagggaaccgggtccttaacgttaccgaacctacgttcccgtacgaaaggtaaccgtaaacgttaacgttaaccggaagggttaaagttttaaccgttttttagtaaccgtttaccgttaacggtaaagttaaccgttaacggtaaccgacgttccggtaaaggtaacgggttaacgggtaaccgggaaccgggtaaacccgtacggttaccgttaaagtttacggtttaaacgttcgttacggggtacgttaaaccggtaaggttaaaacgggaaaccggttaaagggaaaacgggggttacgggttaaagggtttaaccgggggtttacggggtaaacggggttgggggttaaacccgg

SEQ ID NO: 6096 - DNA, 813 bp, Homo sapiens
  misc_feature: GYAE6OF01CJ496.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgactgggttttcctcgttgcttcttttaagaggtgtccagtgtcaggtgcagcgtgggtggagtcggtgggggaggcggtcggtccacggtccggtggggtacggtcccgtaggacgtaccgttcgtcccgttggtcgccgtacggtccggttcgtacggaacctactaactttaccttaacctaaacttacccgttagtcggactacgtcgaccgtacgggttccgggtccccgccgacgggtccctaccggaacgggaccggaagggggtcgtagggggtagggtggggtcggtacggttaggttttaggttttgggttaggtaagttagggtaaacttaaagtacgtaaatttacgtaggacgacgtaaggttccggtacggtaacgggaacgggtaccgttaacttacccgtacctacgttccgaacgtaacggtaagtaaacccttaacgttaaccggtaaagggtaacgttttaagtttttacgtacctttaccgttaagtaaggtacttaacgaacggtaacctacggtaggaacggttacggcggaaacgggaaccgtcggtaacttaggttaacgttattacggtcggttaacggtaccgttaaaggtacgaaaccgaggggtaagggtacggttaggttcgggtaaacgggtgggtacgggttacg

SEQ ID NO: 6097 - DNA, 664 bp, Homo sapiens
  misc_feature: GYAE6OF01CE8VK.24.76.G10.1.454.CMB.1.raw
  modified_base (414)..(414): a, c, t, g, unknown or other
  misc_feature (414)..(414): n is a, c, g, or t
  modified_base (608)..(608): a, c, t, g, unknown or other
  misc_feature (608)..(608): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagcgtggtggagtcgtgggggaggcgtggtccagccgtggggacggtccctggacgactgtcctgtgcagcgtcgtggacacatcttacaatacctagtggcatgcctacgtcgggtcccgccgaggcctaccgaggcgaagggggctagggaggtggggtcggcgttaggtttagttttgggtttagagttagggtaaacttaagtacggtaaattaccgttagnggtaccgtaaggtacgggttcccggtaagggaaccggggcccgttaattacccgaaccgtactccgtaccgaaggtaacgtaactaacgttaccgaagggtaagttaacgtttttgactttacgttacgagtaatacgaactcgtactaggacgtaggtaccggaggtacgacggtatagtagttacgttacgnggttcgacgtagtaggaacgagaagggtagtacgttagggtacgtaggtgggtacg

SEQ ID NO: 6098 - DNA, 723 bp, Homo sapiens
  misc_feature: GYAE6OF01EHV3Y.24.76.G10.1.454.CMB.1.raw
  modified_base (171)..(171): a, c, t, g, unknown or other
  misc_feature (171)..(171): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaacttgggttttcctcgttgcttcttttaagnggtgtccagtgtcaggtgcagctgggtggaggtcgtgggggaggtcggtggtccgagccgtggggacggtccctagacgtactgtcctgtgcagtcgtctggacactattcttacaactacctagtcggactagtcgcctacggttccgggtacccgccgacggtcctaccggagggaccggtaaggggtcggtagggtacgggtggggtacgtacgttaggttttagtttgggttacgaaggtaacggtaaacttaaggtagtaacttagtagtacgacgtaaggtcgtaccggaaggaaccgggtcctactaccactacctacgtacgaacgtaacgtaacctaacgttacggaaggttaacgtttaacgttttacgtactttacctagtacgtaactaaccggtaactacggtaccgtaaggtacgggtaacggtacggaacggtacgtacggtacttagttagttaacgtggttaggtacgtaaggtaacgtaggtaaacggcggtaagggtacggtacggttagggttacggggtaggtgggtaacg

SEQ ID NO: 6099 - DNA, 750 bp, Homo sapiens
  misc_feature: GYAE6OF01CDF41.24.76.G10.1.454.CMB.1.raw
  modified_base (658)..(658): a, c, t, g, unknown or other
  misc_feature (658)..(658): n is a, c, g, or t
  modified_base (694)..(694): a, c, t, g, unknown or other
  misc_feature (694)..(694): n is a, c, g, or t
  modified_base (739)..(739): a, c, t, g, unknown or other
  misc_feature (739)..(739): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttgcctgaacttgggttttcctcgttgcttacgttttaagaggttgtccagtgtcgaggtgcagcgtgggtggagtcggtgggggacggcggtggtccaggcccgtggggacggtccccgtaggacgtacgttcggtcctggtcgaccgaggtccggtcgtacggaacctacgtaacttaccttactaaacttacccgtagtcggacctaagtcgaccgtaccggtccgggtaccccgaccgtaacggcctaccggaacgggacggtaacggggtccgtaggggtaacgggttgggggtacggtacgtttaaggttttacgttttgggtttaagagttaacggaaaacttaagtaggtaaacttacgtaagttcggaacgtaacggtacgggttaccggtaacgggaaacgggtacccgttaactacccgtaaacctacggttacccctacggaaaacggtacgtaaacccgtaaagttaaccgaagggtaactttaagtttacgtactactagaagtatagactanccgtagacgtgacgagacgcgtatcgtattcgtagnggtagagtagacggaaagcggtaaggtagtaggttacggttaggnggtcggtaacg

SEQ ID NO: 6100 - DNA, 847 bp, Homo sapiens
  misc_feature: GYAE6OF01AQ6QP.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagccgtggggacggtccctgacgtactcgtcctgtgcagtcgtcgtggacacattcttacaacgtacctagtggcatgcctacgttcgggtccccgccgacggtcctaccggacgggaccggaacgggggccgtaggggtacgggttgggggtcgggtaccgttaggttttacggtttttgggtttaggaaggttacggtaaaacgttaagttaacggtaaactttaacgttaagtacggtaccgtaaggtacgggttcccgggttaaggggaaaccgggggtacccgttaactttacccgaaacccgttacgttacccccgtaacggtaacgggtaaacccgtaaacctaaacggtttaccccggaaaaggggtaacggtttttaaacgtttttacgggttaacccttttacgtttacggtaaacggttaagttaaccggaaaccgttaccggtacccggtaagggttaaccgggtaacggtttccggggaaacggttacccgtaaccgggttaatttaacgggttacgtttaaccgttaccggttggtaaccggtacgtaaggttaacgggaaacggacgtaaggggtacgttagggttacgggttaacgggaggttcggggtaacg

SEQ ID NO: 6101 - DNA, 851 bp, Homo sapiens
  misc_feature: GYAE6OF01BJD8E.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgctcttttaagaggtgtccagtgtcaggtgcagctggtggagtcgtgggggagcgtggtccagccgtgggaggtccctgagactgtcctggtgcgagcgtctggaccactactcttacaacgttacctagtggacctagtcgcccgtacggtccgggggttaccccgacccggtaagggtcccgtaccccggaaggggtaccggtaaacgggggggtccgttagggggtaagggtttcgggggggtacggtaccggttttaaagggtttttacggttttttagggggtttagaaacggtttacggggtaaaacctttaaagtaggttaaaaccgttacgttaaggttacggaaccgtagggtaccggttacccgggtaagggaaccggggttaccctacgtttaccgacccgtaacgttccctaaccggaacgtaacgtaaacgttaaaccttaccggaagggttaaactttaacgtttttgtaaccgtttacgttacctaaggtaactaacggtaacgtacggtacgtaggtaaggtaacggtacggaaccggaaccgtacgggttacgttaagttacggtttaacgttaccggtaggtacgtaaccggttaaggtacgggtaaaacggtaccgggtaaaggggtacggttaggggtttaaccggtttggggtaaacggggttgggtaaccgg

SEQ ID NO: 6102 - DNA, 804 bp, Homo sapiens
  misc_feature: GYAE6OF01D86XO.24.76.G10.1.454.CMB.1.raw
  modified_base (316)..(316): a, c, t, g, unknown or other
  misc_feature (316)..(316): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaaggaggtgtccagtgtcaggtgcagctggtggagtcgtggggggagcgtggtccagccgtggggacgtccctgagctgtcctgtgcagtcgtgtaggacactacttcttacaactacctagtggactagtcgccgtacgttcgggtccnccgaggcctccggacgggacggtaaggggtcgtaggggtagggttggggtcggtactttaaggttttaggttttgggtttaagtaggttaagggtaaaacttaaagttaggtaaactttacgttaaaggtcggtaccgtaacggggtaccggtttacccggtaaaggggtaaccggggtaacccttaagtttaccccgaaaccctacgttaccccgtaccggtaaaggtaaacgtaaccttaaaccgttaaccggtaagggttaacgttttaatttttacgtacgtttaccgttacgtaagttaacgttaacgaaccgtaaccggtaccgtaagggtaacggtaccggtaacgggtaacggtaccggtacggtaccgtttaagttacgtttaacgtttaaccggttggtaccggtaaggtagttaaacgggaaagtcgggtaaagggtacggttagggttagggttaacgggtgggtcgggtaaccgg

SEQ ID NO: 6103 - DNA, 627 bp, Homo sapiens
  misc_feature: GYAE6OF01AHDP5.24.76.G10.1.454.CMB.1.raw
  modified_base (575)..(575): a, c, t, g, unknown or other
  misc_feature (575)..(575): n is a, c, g, or t
  modified_base (614)..(614): a, c, t, g, unknown or other
  misc_feature (614)..(614): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagccgtggggacggtccctgagactgtcctgtgcagcgtctggacacatccttacaattacctatcggcaagtcgaccacgttcgggtcccgccgaggcctaccgaggcgaaggggctagggaggtgggtgacgtaggtttagtttgggttgagtaggtaaactaagtagtaaatacgtatgcagtacgtccggaggacgggtccgattccaacgactcctaccgagaacgtaacctaagttcccgaaagggtactttaagttttcgtaacttacttacgaagtacttagaacacgtccgtagaagtacggtcgaaggaccaggtctagttacttaacgttagaggttgagttaanaaggaaacgtcggaagggtacggtaggttagggttacgnggggttcggtacg

SEQ ID NO: 6104 - DNA, 694 bp, Homo sapiens
  misc_feature: GYAE6OF01A5OUU.24.76.G10.1.454.CMB.1.raw
  modified_base (678)..(678): a, c, t, g, unknown or other
  misc_feature (678)..(678): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagcgtggtggagtcgtgggggaggcgtggtccagccgtggggacggttccctggagtactgtcctggtcgcagcgtctggacacatcttacaatacctatggcatgcacgtcgggtcccgccgaggcctccgaggcgaaggggctgggagtggggtgtctaggtttatttgggttgagtagggtaaactaagtagaattactagtcgactagtacgtccggtagaacgggccctagttaccacctacgtaccgtaccgaaggaacgtaaactaacgttacccggaaagggtaacgtttaagtttttacggtaactttaccgttacaaggtacgttaaccgaaacgtcggtacccgtaggaacggtaacggtaccggaaaggtacccgtaacgggttacgttaagtacggtttaacgttacgttacggtacggtacggtaagtaacgggaaacgacggtaacggggtaaggtaaggttcggggttaacgggngggttaggggtaacgg

SEQ ID NO: 6105 - DNA, 726 bp, Homo sapiens
  misc_feature: GYAE6OF01CAIBJ.24.76.G10.1.454.CMB.1.raw
  modified_base (308)..(308): a, c, t, g, unknown or other
  misc_feature (308)..(308): n is a, c, g, or t
  modified_base (357)..(357): a, c, t, g, unknown or other
  misc_feature (357)..(357): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagctggtggagtcgtgggggagcgtggtccagccgtggggacgtccctgagtactctcctgtgccggtcctccgattccaccttcaattacttatcggcagtcgctacgtggggtcccnccgaggcctccgagggcgaagggggtctgggaggttcggggtcgccgtnttaattccgtttaatttcggaatagggaaattaatctaaattatttacgcgactaagtaccgttccggtaggaacgggtcccgttacaacccgtatccctaccgaagacgtaacctaaacttacccgaaaactaacttaccttacgttacgtttacgtagtaacctaaattcgtaaccttacggccgtcggtacgtaacgttccgtagggtaaccggtaccgtaccggttacttacgttactttaacgttaccgtggtaacgtaacggtaaaaccggtcccgtttaccccccggttaccttttacggttaaccgttagtttaaccgggttcggggttaccccgtacccccgttagtacggttaccgggg

SEQ ID NO: 6106 - DNA, 727 bp, Homo sapiens
  misc_feature: GYAE6OF01BHV67.24.76.G10.1.454.CMB.1.raw
  modified_base (256)..(256): a, c, t, g, unknown or other
  misc_feature (256)..(256): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagctggtggagtcgtgggggaagcgtggtccaggccgttggggacggtccctgacgactgtccgtgngcagcgtctggacacgatcttacaactacctatggctatgactacgtcgggtccgaccgaggtcctaccgacgggacgaacgggggtcgtacggggaggttcggggttaggcgtttaaggttttagttttgggtttaggaacgttagggtaaacttaaggtacgtaaattaccgtataggacgtaaggtcggttaccggtagggaaccgggtaccttacgttacccaacgtacgttaccgtaccgtaagtaacgtaacctaacgttacccggaaggtaacgttaagtttttacgtaactttacgttaccgtaagtaagttacgaacgtacgtaccgtaggaagggtaccggtaacgggaacggtacgtaacggggtaccttaaggtcgtttaacttacgttggacgtaggtacggtaaggaaacgtaggaacgggtaggtagttacggggtttagaggggttcgggtaccg

SEQ ID NO: 6107 - DNA, 875 bp, Homo sapiens
  misc_feature: GYAE6OF01DIMKA.24.76.G10.1.454.CMB.1.raw
tcagactactatgtcacgaccggtgctcgatttagtcactcatacgagggggggagaggagcccagcactagaagtcggcggtgtttccattcggtgatcagcactgaacacagaggactcaccatggtagtttggcctgaacttgggttttccctcgttgcttacttttaaggaggttcgtccagtgtcgaggtgcagcgtgggttggaggtcggtagggggacggtcggtcgggtcccggccgtggggacggtcctggacgtctgtcctggtcgcagtcgtcgtacggacacgtacttcttacaattaaccgtagtcggctacgtcggtaccgaccggttcggggtacccccgacgtaaggtcccgtaccggaacggggtaccggtaacggggggtcttaggggaacgggttcgggggtacggtaacgttttaggtttttagggttttcgggttttagaacggtttaacgggtaaactttaaagggttacggtaaaactttacggtaacggtcgtaccggtaaggggtttacccgggttaccgggtaaggggtaaacccggggtccttaaacgttaacccgtaaccctaacgttaccctaacggaacggttaacgaaaccgtttaacgttaaccggtaaggttaacgtttaagtttttcgtaacgtttccgttaagaacgtacgtaacgtaaccgtcggtaccggtagacgggtacgtaaccgggaacggtacgtaccggttagtaacgtttacggttaacttcgggttacgacggtaccggttaaggtaaggtaaaacgggtcgggttaagggggtaccgggtttcgggtaacgggttaagggttccgggtaaacggttcggttaaaccggg

SEQ ID NO: 6108 - DNA, 785 bp, Homo sapiens
  misc_feature: GYAE6OF01CRG1T.24.76.G10.1.454.CMB.1.raw
  modified_base (741)..(741): a, c, t, g, unknown or other
  misc_feature (741)..(741): n is a, c, g, or t
  modified_base (774)..(774): a, c, t, g, unknown or other
  misc_feature (774)..(774): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggttgtccagtgtcgaggtgcagctgggtggagtcgtggggaggcgtggtccaggccgtggggacgtcccgtgacgcctgtcctgtgcagcgtctggacactatcttacaaacttacctagtcggactagtcgcgaccgtcgggccccgaccgaggtccctaccggacggacgaacgggggtcctggggtagggttacggggtcggacgttaggttttaacggttttggtttacggaagttaacggggtaaaacttaaaggttacgtaaaacgtttagttaacgtggaacgtacgggtaacgggttacccggtaagggtaaacccggggtaccttaacttacccggtaaccctaacgttccctaaccggaagtaacccgtaaacttaaaccggtttaccggaagggttaaagttaaagtttttaacggtaaacttccgttaacgtaaacgttacgttaaaccggaaaccgttcggtaccggtaacggacgggttaaacgtacggggtaacgaaccggtacggtattacggttgtaaacggttcgtagggtcgaagttaggtaagggaaccgngggttaaggtaacggttacgttagggttacggngggtagggtcg

SEQ ID NO: 6109 - DNA, 788 bp, Homo sapiens
  misc_feature: GYAE6OF01CBOMF.24.76.G10.1.454.CMB.1.raw
  modified_base (419)..(419): a, c, t, g, unknown or other
  misc_feature (419)..(419): n is a, c, g, or t
tcagactactatgtcacgaccggtgctcgatttagtcactcatacgagggggggagaggagcccagcactagaagtcggcggtgtttccattcggtgatcagcactgaacacagaggactcacagtgggagtttcggcctgtaacgtttcgggtttttccctcgttcgtctttacgttttaaggaggttcgtcctaggttgtcgagggtgcaggcgtgggtggagtcggtgggggacggtcggtggccacggccgtggggacggtccctaggagtacgttcgtccgttgtcgcctaggtccgtcgtacgaactaactacttaccttacaaacttaccgtagtcggaccagttcgaccgtacggttccgggccccgaccggacgtcccgtaccgacggacgggtaacggggcttaggggngggttcggggcgtagttaggttttggttttagggttagaagttacggaaaattagttagtaaacttacgtgtacggacgtagtacggttacccggagggaccgggtacgtaccttaccgaaccgtacgtccgttaccgaacggtaacgtaacgttaaacgtaacccgggtaaggttaacgtttaacgttttaagtttacgttaccgtttaaccgaagttacgtaagaaccggtttacgaccggtaggtaacggtacggtaacgggtaacggaaccggtcccgtaaggttagttacggttacgtagtacggtagtacgaggttaacgaacggtacggaaggtaggttagtagggttcggaggtggtacgg

SEQ ID NO: 6110 - DNA, 813 bp, Homo sapiens
  misc_feature: GYAE6OF01ALA60.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccaggcctggggaggtccctgagctgtcctgtgcagcgtctggacacattcttacaacttacctatggacagtgctaccgttcgggtccccgccgtacggcctaccggagggaccgaagggggctaggggagggttggggtaggtcgttaggttttaggttttgggtttacgagttagggtaaacttaaagtacggtaaatttacgtaagtcggtacgtaacggtacggtttacccgggtagggaaaccggggtccgttaagtttacccgaacccttaacgttcccgttaaccgaaacgggtaaaccgtaaacccgtaaacgtttacccggtaaagggttaagttttaaacggtttttagttactttacgtttaacgaagtaacgtacgtaaaccgtacggtaacccgttagggaacggtacggttaacgggaacgggaaccgttacgggtaccgttaagttacggttaaacgtttacggtacggttcggtaaccgggttaagttaaacggggtaaacgggacgggtaaaagggggttaagggttaacgggtttagggggttaccggggtaaggggggttacggggttaacccggg

SEQ ID NO: 6111 - DNA, 933 bp, Homo sapiens
  misc_feature: GYAE6OF01ATE6D.24.76.G10.1.454.CMB.1.raw
  modified_base (187)..(187): a, c, t, g, unknown or other
  misc_feature (187)..(187): n is a, c, g, or t
tcagactactatgtcacgaccggtgctcgatttagtcactcatacggagggggggagaggagcccagcactagaagtcggcggttgtttccagttcggtgatcagcacctagaacacgagaggacctcaccagtggtagtttggcctgtaacgttgggttttcctcgttgtactttacgttttaagngggttgtcctaggtgtcgaggtcgcgaggtcggtgggtgggtaggtccgggtggggggacgtcggtacggtccgacggtccggttggggtaccgtcccgtgacgttcgttgtccctagtcgacgtacggtcggttccgtacggaacctacttacttacccttactaaaccttaaccgtggtacgacgttacgtcggaccgtaccggtccgggaccccgaccggcggtacccgacgggacgggacgggtaacggggtcggtaggggttagggttcggggtagttacggtttaaggttttaggtttagggttaagtaaggttaaggtaaacttaggtaactaacgtagttgtacggacgttacggacgggttaccggaacggaccggttaaccgtaccttaccgaacccgtacttaccgaacgaacgtaaccgttaagttaactaccggttaaggttaaacttttacggtttatacgtttactaccgaaggttactaaaccggtacgtaaccggtaccggttaggaacgggttacggaaccccggggaacgtttaaccggacgggttttaacgtttaaggggtttaccttttaaagggttaaccgtaggggtttaaccggtaaagggaaacggtttaaacggggaaaaccgggggtttaagggaaaccggggggttttaagggggttaaaccgggttttacgggggggttaaacggggtttccggggaaggggttttacccccggggg

SEQ ID NO: 6112 - DNA, 731 bp, Homo sapiens
  misc_feature: GYAE6OF01BI2QM.24.76.G10.1.454.CMB.1.raw
  modified_base (174)..(174): a, c, t, g, unknown or other
  misc_feature (174)..(174): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctgttgcttcttttaagaggttntccagtgtcaggtgcagctggtggagtcgtgggggagcgtggtccagccgtgggacggtccctgacgactgtcctgtcgcgacgcgtctggaccactattccttacgaattaccctagtcggtactagtcgccgtacggttccggggtcccgaccgaacggtcccttaccggaagggtaccggaaagggggcgttacggggtagggtcgggggttacggaccgtttaaggttttacgttttgggttagtaacgtaggtaaaccttaagtagtaaacttacgtagtcggactaggtacggttccggaggaaagggtccctattaccgactactacctacgaagtacgaactacgttaccgaggttacgttaatttgaacttcttagaagtacttaagaaccgtagtaccgtaaggtacgtaacggtacggtaacggacgtaacgtacgtaacgttagttaccgttacggtgacgtaacgtaaggttaacggaacggtaccggtaaagggtacggttaagggttacccgggttaacggtaagggggttgggtaaccggg

SEQ ID NO: 6113 - DNA, 829 bp, Homo sapiens
  misc_feature: GYAE6OF01BPZE1.24.76.G10.1.454.CMB.1.raw
  modified_base (754)..(754): a, c, t, g, unknown or other
  misc_feature (754)..(754): n is a, c, g, or t
  modified_base (810)..(810): a, c, t, g, unknown or other
  misc_feature (810)..(810): n is a, c, g, or t
  modified_base (821)..(821): a, c, t, g, unknown or other
  misc_feature (821)..(821): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttcggcctgaactgggttttcctgttgcttcttttaagaggtgtccagtgtcaggtgcagctgggtggagtcgtgggggagcgtggtccagccgtggggacgtccctgacgtacctcggtacccgtgcgagccgttctgggacctactacttaccttaccgaaacttacccgttagtcgggtacctaagttacgggacccgtaaccggttccggggggttacccccgaccggtaacgggggtcccttaaccccgggaaggggtaccgggtaaacgggggggtccttagggggtaaggggttcgggggttacgtacgttaaggttttttacggttttacgggttttaggaacggtttacggtaaaccttaaagttacggaaaacccttttgtaacgttcgggtaacgtaacggggttaacgggttacccgggtaagggtaaaccgggggtcccttaacgtttacccaacccgtacttaccccgtaccggaacgtaacgtaaaccctaaacggtttcccgaaagggttaacgtttaagttttacggtaacttcgttagagtacgtagaactcgccgtaagacggtacggtacggacgtacgacggttattacgtacgttagttcgnggttacgcgttaagtaacggaacgtacggaagggtaggtacgtttggggtaacggngggttacgggngttaccgg

SEQ ID NO: 6114 - DNA, 758 bp, Homo sapiens
  misc_feature: GYAE6OF01BJRUK.24.76.G10.1.454.CMB.1.raw
  modified_base (192)..(192): a, c, t, g, unknown or other
  misc_feature (192)..(192): n is a, c, g, or t
  modified_base (385)..(385): a, c, t, g, unknown or other
  misc_feature (385)..(385): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagngtgggtggagtcggtgggggagtcgtcggtccaggccgtggggacggtccctggacgtctcgtccgtgtcgcgaggccgtcgtacggaacctactacttaccttacaaacgttacccttagtcggtactaagttcgccgtaccggttcgggtcccgaccgacggtcctccgagggtacgacggggcgtagggnggtcgggtgtacgttaagtttgtttaggttcgagttaggaacttaagtagaaactcgtaagtcggtaagtaggtacggttaccggtaagggaccgggtaccgttacttacccgtaaccgtaccttaccggaccccgtaaagtaacgtaaacgttaacgttaccgaaagggttaacgttttaagttttacggtactttacgttaataggtaacgtacgtaaacgtcgtaccggtaggtaacggtaccgggttaaacggacggtaaccgacgggtaacttaggttaacgttagttaccggtgtacggtagaaaggttacggaaaaggcggaaaggtagggttaacggttgggtacggtaacggggtggtaaccgg

SEQ ID NO: 6115 - DNA, 658 bp, Homo sapiens
  misc_feature: GYAE6OF01CA7UL.24.76.G10.1.454.CMB.1.raw
  modified_base (578)..(578): a, c, t, g, unknown or other
  misc_feature (578)..(578): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggttgtccagtgtcaggtgcagctgggtggagtcgtggggggagcgtggtccagccgtggggacgtccctgagactgtcctgtgcagcgtctggacacatcttacaatacctatggcagtgccacgtcggggtcccgccgacggctccgagggcgaagggggctgggaggtggggtggctaggttttagtttgggttagagttaggaaacttaagtagtaaattacgtagtgacgaagtacggttaccggtagggaacgggtcctacgtttccaacctacgttcctaccgaaagtacggaaacctaacgttaccgaaggtaacgtttaaagtttttacgtactttcgttacgtaagtaacgtacgaaacgcgtaccgtaggaacggtggtaaccggaagaccgacggtntaggttacgttattacggtagtcgacgagttaggaacgtagggacggtaggttacggtgggttacggtgggtgggtaacg

SEQ ID NO: 6116 - DNA, 774 bp, Homo sapiens
  misc_feature: GYAE6OF01EWDHV.24.76.G10.1.454.CMB.1.raw
  modified_base (172)..(172): a, c, t, g, unknown or other
  misc_feature (172)..(172): n is a, c, g, or t
  modified_base (187)..(187): a, c, t, g, unknown or other
  misc_feature (187)..(187): n is a, c, g, or t
tcagactactatgtcacgaccggtgctcgatttagtcactcatacagggggggagaggagcccagcactagaagtcggcggtgttccattcggtgatcagcactgaacacagaggactcaccatcggagtttggcctgaactgggttttcctcgttgctcttttaagaggtntccagtgtacaggtncagctggtggagtcgtgggggagcgtggtccagccgtgggacggtccctagacgtactcggtccctgtcgtcagtcgttctacggaccactactctttacgaaactaccctagtggacctatcggcctaacggttggaccccgccgtacgggccaccgtagggccaaagggggtcctgggaggttggggtagtaccttaggtttagttttcgggttaggaaattcggggaaacttaaaggtcgtaaaacgtttaccgttaaggtcggtacgtaaacgggacgtttacccgggttaaggaaaccggggtccctaactttacccggaacccgttaacgttaccgttacccggaacgtaacgtaaaccgtacgttaccgaacggtaagtttaacctttagtacgttaccgtttacgacggttaactagaaccgtaacggtacgtaaggtaacgtaggttacgaacgggtaacctacgggtacttacggtaggttaaacgttaccgtggtacgtacggtaaacgttaggaaaccggtaacgggtacgtaaacggggtacggttaacgggttcggtaaggggtgggtaacgg

SEQ ID NO: 6117 - DNA, 877 bp, Homo sapiens
  misc_feature: GYAE6OF01DAG7F.24.76.G10.1.454.CMB.1.raw
  modified_base (862)..(862): a, c, t, g, unknown or other
  misc_feature (862)..(862): n is a, c, g, or t
tcagactactatgtcacgaccggtgctcgatttagtcactcatacagggggggagaggagcccagcactagaagtcggcggtgtttccattcggtgatcagcactgaacacagaggactcaccatggtagtttggcctgtaacgttcgggtttttccctcgttgtcctttacgttttaaggaggttcgtaccgtaggttgtacgagggtgcgaggtcgttggggtgggtaggttcgggtggggggaggtccggtcggtccgacggtccggtggggaccggttcccgtaggacgtccgttcgtcctggtcgcgaggtcgttcgtacggaaccactacttccttactaaacctccgtagtcggacctagttcgaccgtaccggttccggggtaccccgccgtaacgggtcccgtaccggacgggtaaccgggtaacgggggtccgtagggggtacgggttcgggggtacgtacgtttaagggtttttcggttttgggttagtaaacggtttaacgggtaaaaactttaaggtaacgttaaaacgtttaaccgttaggtacggaacggtaacggtacgggttaacccgggtaagggtaaacccgggtaccggttacttaacccgaacccttacgttaaccccgtaacgaaacggtaacgtaaaccgttaaccgtaccggtaaggttaactttaagttttactaaccgttacgttacgaagtaacgttaacgtaaccgtacgtccgtaagacgggtaacgacgggtaacgaccggtacgtactttagttcgtacgttagttcgggtaacgagtaacgggttaagaacggacggtaagggtaccggttagggtaccgggttacgggngggttacggtaacgg

SEQ ID NO: 6118 - DNA, 803 bp, Homo sapiens
  misc_feature: GYAE6OF01A5GVD.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagcgtggtggagtcgtgggggagcgtggtccaggccgtgggacggtccctgacgtactcgtcctggtgcacgtcgtcgtggaaccactacttccttacaaacttaccctagtcggctagtcggtacctaccggttcggggtccccgccgacgggtccctacccggagggaccggaacgggggtcgtaggggtagggtcggggtaggtaccgttaaggttttagttttcgggtttagaaggttaacgggtaaactttaaagtagtaaaacgtttacgttaagtacggtaacgtaagggtaccggttaccggtaacgggtaaccgggggtaccttaacgtttacccgaaccttacgttacccgtaccggaacggtaaactaaccgttaaaccgttaaccggtaaacgggttaagttttaaacgtttttacgttaacctttacgtttacgaagtttaacgtaacgtaaccgtaacggtaccgttaggaacggttacggtaacggaacgggtaacccgtacggttaacgttaggttacgttaccgttaggtaggtacgtagtaacgtaaggaacgaggtaacgggtagtaggttaggttaggtagggttagggtacgg

SEQ ID NO: 6119 - DNA, 728 bp, Homo sapiens
  misc_feature: GYAE6OF01D4TA5.24.76.G10.1.454.CMB.1.raw
  modified_base (152)..(152): a, c, t, g, unknown or other
  misc_feature (152)..(152): n is a, c, g, or t
  modified_base (191)..(191): a, c, t, g, unknown or other
  misc_feature (191)..(191): n is a, c, g, or t
tcagactactatgtcacgaccggtgctcgatttagtcactcatacagggggggagaggagcccagcactagaagtcggcggtgtttccattcggtgatcagcactgaacacagagactcaccatggagtttggcctgaacttgggttttccncgttgcttcttttaagaggtgtccagtgtcaggtgcagntgggtggagtcgtgggggagcgtggtccagcctgggacgtccctggagactgtcctgtgctagccgtcgtcggaactacactcttacaacgtaccctagtggactatgcctacgttggggtcccgtccgaacggtcctccgacggacgaaagggggctacgggaggtggggtgcgtagttttagtttgggtttagaacgtaggtaaactaaacgtagtaaataacgttaatacggactacggtacggttaccggtaaggaaacgggaccgtacgttaccaacctaacgttacctaccgaaagggtaacgaaactaacgttaccgtaaggttaaagtaaacgtttttggtaacttattaaccgagttaacgtacgaacgtaacgccgttaagacggtaagtcggtaacggaaccgtaacggtcttaaacgtacggttaaacttaaccggttggtacggaacgggtaacttaaagggaaaccggacgaaaggggttacggtaaggttaaggggtttaccggtaagggtggggtaaacgg

SEQ ID NO: 6120 - DNA, 999 bp, Homo sapiens
  misc_feature: GYAE6OF01BFRII.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagagactcaccatggagtttggcctgacttgggttttcctcgttgcttcttttaagaggtgtccagtgtcaggtgcagcgtgggtggagtcgtgggggagcgtggtccagcccgtgggacgtccctggagtactgtcccgtgtacgcgtagccgttcgtggaacctacgacttacctttacaaaaccttacccgttaagttcgggacctaattcggaccctaaccggttccggggttccccgaccggacggggtacccttccggaaacggggccggtaaacggggggtccgttaggggggacgggttacggggggttaacggtcccgttaagggttttttaaggtttttcggggtttaggtaacggttaaacggttaaaaccgttaaaaggtttacggaaaacttttaacggtaacgtagggtaaccctaaggggttaacccggttaaccccgggtttaaggggaaaacccggggtcccgttaaacttaaccccggtaaccttaaccgtttaccccgaaccgggtaaaccggtaaggtaaaacccttaaaccgtttacccggtaaaggggttaaccgttttaaagttttttaccgggtaaccttttaaccctttaggaaaccgggtttaactttaaacgggaaaccggttaaggtacccccggttaagggtaaccgggttaacccgggggttaaaccgggtaaaccgggtacccgggtacccgggttttaaacgttaacgggtttaaccgggttttaaaacgttttccggtacggggtttaaaccggaccggggtttaaagtaaaccgggaaaacgggttacggtaaaaggggggttacgttaacgggtttagggggtaacccgttaggggggttacgtaacccgggg

SEQ ID NO: 6121 - DNA, 755 bp, Homo sapiens
  misc_feature: GYAE6OF01DX86M.24.76.G10.1.454.CMB.1.raw
  modified_base (687)..(687): a, c, t, g, unknown or other
  misc_feature (687)..(687): n is a, c, g, or t
tcagactactatgtcacgaccggtgctcgatttagtcactcatacgaggggggagaggagcccagcactagaagtcggcggtgtttccattcggtgatcagcactgaacacagagactcaccatggagtttgcctgtaacgttgggttttcctcgttgcttacgttttaaggaggtcgtccagttgtacgtaggtgcagcgtggtggagtcggtggggacgcgtggtccagtccgtgggacgtccagagtacgtcgtccgtgtcgcgacggtcgtcgtaggaacctactacttccttaacaaacttaccgtagtcgacgtagttccgaccgtacggttccgggtaccgaccgtacgggtcctacccggaaggggtaccggtaacgggtgtacggggtacgggtggggtacgtacgtttaaggttttgttttgggttaacgaaggttaacgtaaagtaacgttagtaaacgtttacgtaaggtcaacgtagggttacggtaacgggtacgggtaaccggtacccgttagttacccgaccgtacgtaccttaccgaaagtacgtaaaccgtaacgtacgaaggtaacttttagtttacgtactttacgtagtaacgtagtaacgacgtaccgtgtaacgagtaacgcggaacgtaccaggtacttacgttagttaccgttagtacggtntaacggtacgtaaaggacggtaacgagggtaaacgttacggtagggttaccggtagggtggggtaacc

SEQ ID NO: 6122 - DNA, 807 bp, Homo sapiens
  misc_feature: GYAE6OF01EUUEB.24.76.G10.1.454.CMB.1.raw
  modified_base (208)..(208): a, c, t, g, unknown or other
  misc_feature (208)..(208): n is a, c, g, or t
  modified_base (304)..(304): a, c, t, g, unknown or other
  misc_feature (304)..(304): n is a, c, g, or t
tcagactactatgtcacgaccggtgctcgatttagtcactcatacagggggggagaggagcccagcactagaagtcggcggtgtttccattcggtgatcagcactgaacacagagactcaccatggagtttggcctgaacgttgggttttcctgttgcttcttttaagaggttgtccagtgtcgaggtgcagcgtaggtggagtcggngggggaggcgtggtccagccgtggggacgtcctggagaccttgtccgtgtgcaggtcctcgtaggacacgtactctttacaaacgttaccgttagnggtacctaagtcgaccgtaccggttccggggtaccccgaccgacggttcccaccggacgggaccggtaacggggtcggtagggtacgggttggggtacgtccggtttaaggttttaacggttttgggttaggtaagttaacgggtaaacttaagtagtaaactcgttaagtccgagtaacgggtacggttaccggtaacgggaacggggtacccttacgttaccgaacccgttaccgttcctaccgaacggtaacgtaaccgttaacgttacccgggtaaaggttacgtttaaagttttacgtacgtttacgttacgagttaacgtaccgtaacgtacggttactacgggaagttaccgggaacggtacggacccggaacggttcttaggttacgtttagttaccgttagggtaccggacggttagtaacggtaaggtaccggggtaaaggttcgggttaaggttacccggggttagggttaacgggcgggttttaaacccgg

SEQ ID NO: 6123 - DNA, 729 bp, Homo sapiens
  misc_feature: GYAE6OF01CDK4N.24.76.G10.1.454.CMB.1.raw
  modified_base (260)..(260): a, c, t, g, unknown or other
  misc_feature (260)..(260): n is a, c, g, or t
  modified_base (383)..(383): a, c, t, g, unknown or other
  misc_feature (383)..(383): n is a, c, g, or t
tcagactactatgtcacgaccggtgctcgatttagtcactcatacagggggggagaggagcccagcactagaagtcggcggtgtttccattcggtgatcatcactgaacacagaggactcaccatggagtttggcctgaactgggttttcctgttgcttcttttaagaggtgtccagtgtcaggtgcaggcgtggtggagtcgtgggggaggcgtgactccaggccgtggggacgtccctggacgtctcgtcctgtgcgngcgtcgtggtaccactattaccttacaaacttacctagtcggacctagtcgcctacggtcgggtcccgccggtaggtcccgtaccggagggacggtaacggggcgtaggggtacggttggggnggtacgtaggttttactttggtacgttttagaagttaagggaaacttaagtaccggtaaattacgttagtacgacgtaaggtacggtaccgggtaggtaaccgggtccgtactccgaacctacgtcctaccgaacgtaacgtaacgtaaccgttacgtaaggttaagttaacgttttacgtacttacgttaacgtaacgttgtaacgaacgtacggtaccgtaggtaccggtacggtacggacggtaacgtacggtacttaggtaagttacgttacggtaggtacgtacggtagtaaaggtacggtaacgggaagggtaggtaagggttgggtcggtaaacggggg

SEQ ID NO: 6124 - DNA, 905 bp, Homo sapiens
  misc_feature: GYAE6OF01D5VZJ.24.76.G10.1.454.CMB.1.raw
  modified_base (236)..(236): a, c, t, g, unknown or other
  misc_feature (236)..(236): n is a, c, g, or t
tcagactactatgtcacgaccggtgctcgatttagtcactcatacgaggggggggagaggagcccagcactagaagtcggcggtgtttccattcggtgatcagcactgaacacagaggactcaccatggagtttcggcctgaacgtttgggttttcctcggttgtctttacgttttaaggaggttcgtccgtaggttcgtcgtaggtgcgtacggcgttgggtgggaggttcgggnggggggaggtcggtcgggtaccgaggtccggtacgggggacggttccccgtggtaacggtctttcggttcccggttggtacgacgacggtccggttacgtacggaccactacgttccttacctaaacttacctagtggacctagtcggaccgttacggtccggggtccgaccgacgggtcccgtaccggaagggtccgggaaggggtcggtggggtacgggtcggggtacgttacggtttaggttttacgggttttagggttacggtaacgttagggttaaacgttagtaaccggttaaatacgtttaaacggtcggtacgtaaggggtaccggtttccggggtaaggtaaacccggggtaccgttaaccttacccgtaacgtaccgttaccgtacggtaaacgtaacgtaaccgttaacgttacggaaacggggttaactttaagttttcggttaacctttgttaacgaaggttaacgtacgaacgtacgtacgacggggttaacgtaccgggtacggaacggtaaccggtacggtttaacgttacggttacggttatttaccgggttacgtcgggttaaaggtacggttaaagggtaaccgggtaggaaacgggggttacgttacgggggttaaagggttcggggttaagggtccgggttaacgggg

SEQ ID NO: 6125 - DNA, 724 bp, Homo sapiens
  misc_feature: GYAE6OF01B2WMD.24.76.G10.1.454.CMB.1.raw
  modified_base (172)..(172): a, c, t, g, unknown or other
  misc_feature (172)..(172): n is a, c, g, or t
  modified_base (352)..(352): a, c, t, g, unknown or other
  misc_feature (352)..(352): n is a, c, g, or t
  modified_base (522)..(522): a, c, t, g, unknown or other
  misc_feature (522)..(522): n is a, c, g, or t
  modified_base (674)..(674): a, c, t, g, unknown or other
  misc_feature (674)..(674): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaacttgggttttcctcgttgcttacttttaagnggtgtccagtgtcaggtgcagcgtgggtggacggtcggtggggggaggtcggtcggtccaggccgtaggggacgtcccgtagacgtcgttcgtccgtgtcgccgtaggtccgttacgaggacctactcttacttactaaacttaccgtagtcggactagtcgacgtacggtccgggaccncgacggtcccaccggaggaccggtaaggggcgtaggggaggttcggggtacggtacgtttaaggttttggtttttgggttaacgagttaagggtaaacttaagtagtaaagtttacgagtacgaacgaggttcggtaccgtagggaacggtcccgtattaccgaaccgtntacccgacgtaaggacgaaacttaacgtacgaagggttaatttaacgttttagtaactttcgtaacgagttacgaaccgaacgtcggtaccctaaggtaaccggacggtaacggaccgtaacgacggttactagttagttacgtacgtgggngacgtagtaacggagaggaaggtggtagttacgggtggaacggtggtacg

SEQ ID NO: 6126 - DNA, 720 bp, Homo sapiens
  misc_feature: GYAE6OF01B0W9Z.24.76.G10.1.454.CMB.1.raw
  modified_base (667)..(667): a, c, t, g, unknown or other
  misc_feature (667)..(667): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacgttgggttttcctgttgcttcttttaaaggaggtgtccagtgtcaggtgcagcgtgggtggaggttcggtgggggacggtcgtcggtcccaggtccgtggggacggttccctgacgtacttgtcctggtgcgaggtcgtgtacggactactcttccttacaaactccgttaagcggtacagtcgacgtacggtcggggtcccaccgacggtccgtaccgagggaccggaagggggtcgtagggtacggtggggtcgtacgttaggttttagttttcgggttagaacggttaggtaaacttaaggtactaactttactaggttgaacgtaggtacggttaccggtaacgggaaccggtccctaagttacccaccgtacttaccgaccgtaaggaaccgtaaccgtaacgttaccggaaggttaacgtttaacgttttcggtaactttacgtagtaacgtataacgactacggtaccgtaggaacggtgtacggagtaccgtagtatagttagtactacggtgtacgngtaagtaggaaacgtcgggaggtaggttaggtaggtacgggtaggtggtacgg

SEQ ID NO: 6127 - DNA, 791 bp, Homo sapiens
  misc_feature: GYAE6OF01D1PNC.24.76.G10.1.454.CMB.1.raw
  modified_base (258)..(258): a, c, t, g, unknown or other
  misc_feature (258)..(258): n is a, c, g, or t
  modified_base (303)..(303): a, c, t, g, unknown or other
  misc_feature (303)..(303): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagctgggtggagtcgtgggggaggcgtggtccaggccgtggggacggtccctgagactgtcctgtgcngcgtctggacacatcttacaatacctatgcatgcacgtgggtccncgagctccgaggcgaaggggctggaggtggtggctaggtttgtttgggtttagagttaggaaacttaagtgtaaattacgtatggacgtaaggacggttacccgtagggaaaccggggtaccctaagtttaccgaacccgtacgttaccctaccgaaggtaacgtaacctaaacgtttacccgtaaggggttaacgtttaaacgttttttcggtaacttttaccgtttaacggtaaacgttaacgttaacggtaaaaccgtacggttaacccggttaagggaaacgggtacggttaaccgggaacgggtaacccgtaaccggggttacttaaggtttacggtttaaaccgtttaacggtttacgggttacggggtaaaccgttaacggttaaacggggtaaaaaccggtggggtaaaacgggggtaacgggttaaacggttttacggggggtttaaaccgggaaagggggtttcgggggtaacccggg

SEQ ID NO: 6128 - DNA, 720 bp, Homo sapiens
  misc_feature: GYAE6OF01EEJ2C.24.76.G10.1.454.CMB.1.raw
  modified_base (186)..(186): a, c, t, g, unknown or other
  misc_feature (186)..(186): n is a, c, g, or t
  modified_base (234)..(234): a, c, t, g, unknown or other
  misc_feature (234)..(234): n is a, c, g, or t
  modified_base (265)..(265): a, c, t, g, unknown or other
  misc_feature (265)..(265): n is a, c, g, or t
  modified_base (313)..(313): a, c, t, g, unknown or other
  misc_feature (313)..(313): n is a, c, g, or t
  modified_base (673)..(673): a, c, t, g, unknown or other
  misc_feature (673)..(673): n is a, c, g, or t
tcagactactatgtcacgaccggtgctcgatttagtcactcatacagggggggagaggagcccagcactagaagtcggcggtgttccattcggtgatcagcactgaacacagaggactcaccatggagtttggcctgaacttgggttttcctgttgcttcttttaagaggtgtccagtgtcaggtncagctgggtgagtcgtgggggagcgtggtccagccgtgggacgtcccngagactgtcctgtgcagcgtctaggacacgnttcttacaaactcctagtaggccagtcgacctacgttcggggtacccnccgagggtccctaccgagggtccgaaagggggtctacggggtaggtgggtcgacgtgtttaagtttgggttagagttaggtaaactagtaggtaaataaccttagtacggactaaggaccgttcggggtaacggaaacggggggtaccctaagtttaccccaaaccgtacgttaccccgtaaccgaacggtaaagtaacccgttaaacgtttccgaaagggttaacgtttaaacgtttttacgtacgtttaccgttacgaaaggtacttaggaaacctggtaaccctaggtacgttaacggacggtaacggaccgtaacggtacttaagtacgttaagttaccgtaggtacggagttaanacgaacgacggaggtacggttagtcgggttaaggagggtcggtaacg

SEQ ID NO: 6129 - DNA, 630 bp, Homo sapiens
  misc_feature: GYAE6OF01BTMU8.24.76.G10.1.454.CMB.1.raw
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
  modified_base (517)..(517): a, c, t, g, unknown or other
  misc_feature (517)..(517): n is a, c, g, or t
  modified_base (549)..(549): a, c, t, g, unknown or other
  misc_feature (549)..(549): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctggggagtccctgagactgtcctgtgcagcgtctggacacatcttcaatacctatggactatcgctacgtcggggtcccgccgagggcctccgagggaccgaagggggtcctgggaggtcggggtggactaggttttacgttttgggtttagattagggaaacttaaggtagtaaattacgtatcggactaggtacggttccggtaaggaacgggtccctagttccaacctactcctacgagagacaacgttccgagggtaatacgttttgtactctttanacgttanacgaacngtacctaggagtagtcggaagggtacacggtntaagttgttaacttacgtggtcggacgtagtacgaaaggcgaaggggtacgaggttacgggtttcggagggttgggtacgg

SEQ ID NO: 6130 - DNA, 916 bp, Homo sapiens
  misc_feature: GYAE6OF01DUNMC.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcacatggagtttggcctgaacttgggttttcctcgttgtcttacttttaagaggtgtccagtgtcgaggtgcagtcgtgggtggaggtcggtgggggaggtcggtggtccaggtccgtggggacgtccctggacgtcgttcgtccgtggtcgcgtaggtccgttcgtacggaacctactacttacctttaactaaacgttaccctaggtcggactacgttcggactaccgggtttcggggaccccgcggaacggtccctaccggaaggggtacccggaagggggttcgtaggggtagggttcggggtacgggtacgtttaagggttttaagttttggggtttaaggaacggtttaacgggtaaaactttaaaggttacggttaaaactttaccggtaaagtcggggtaactaaacgggggttaacggtttaccggggtaagggtaaaaccgggggtacccttaaacgtttacccgaaaccgttaaccgttaccgtaaccggaaacggtaaacggtaaaccgttaaaccggttacccggtaaaggggttaaacgttttaacgttttacgggttaaacgtttacccgtttaaggaaacggttaacttaacgggtaaacccgtacgggtaacccgttagggtaacgggtaacgggttaacccgggaacggtaaccggtagtaaccgttaagtttacgttaacgttacgggtacggtttacggaaccgtaagggtaaaccggaaacgggtacgaaacggggttaggttacggttaggggttacggagggttacggggtacg

SEQ ID NO: 6131 - DNA, 789 bp, Homo sapiens
  misc_feature: GYAE6OF01C0C4V.24.76.G10.1.454.CMB.1.raw
  modified_base (730)..(730): a, c, t, g, unknown or other
  misc_feature (730)..(730): n is a, c, g, or t
tcagactactatgtcacgaccggtgctcgatttagtcactcatacagggggggagaggagcccagcactagaagtcggcggtgtttccattcggtgatcagcactgaacacagaggactcaccagtggagtttggcctgaacttgggttttcctcgttgtcttcttttaaggaggttcgtccaggttgtcaggtgcgagcgtgggtggagtcggtgggggaggcgtggtccgagccgtgggacgtcccgtgagtctgtccgtgtgcagtcgttcgaggacactattccttactaactaccgttagtcggtactagttcgaccgtacggtccggggtaacccgccgaacggtcttaccggaacggacgggaacggggtcgtagggtaacgggttcggggtaggtacgtttaaaggttttggttttgggtttacgaggttaacggttaaaactagtaacggtaattaacgtagtacggtaacgaggtaccgtttcggaacggtaccgggactacttaccgacccttagacctacgaaacgtacgtaacgtaacttaccgaaggttaactttaagttttaccgaagtttacccgttagaagttaacacggtaagtaaccgtaccgggtaagaacccggtagggtaccgggtaacgtaaccgggaccgttaagttaacggttcgttaaaccgttaaggtcggtttacaaccggttaaagtaccggaaaacgggnggttaaacgggtaagggttaccgggtaaagggttcccgggaggggttacgggttaacgg

SEQ ID NO: 6132 - DNA, 744 bp, Homo sapiens
  misc_feature: GYAE6OF01AVXCG.24.76.G10.1.454.CMB.1.raw
tcagactactatgtcacgaccggtgctcgatttagtcactcatacgagggggggagaggagcccagcactagaagtcggcggtgtttccattcggtgatcagcactgaacacagaggactcaccatggagtttggcctgaacttgggttttcctcgttgcttacgttttaaggaggtgtccagtgtcgaggtgcagcgtgggtggagtcggtgggggaggcggtggtccaggccgtggggacgtccctggacgtcgtcgtccgtgtcgcgaggtcgtcgtacggacactattccttacaaacgttacctagtcggactagtcggccgtaaccggtcggggtaccccgaccggtacggtcccgtaccggaggggaccggaagggggtcgtggggtagggtcggggtcggtacgttagggtttgttttcgggttagaagtacggtaaactaagtacgtaaatacgtgtcggacgtaagggtacggtaccggtaagggaccgggtccttaacgttacccaaccgttcgttaccgaaccgaaggtaaacccgtaacgttaaccgtaccggtaaagggttaacgttttaacgttttcgtaaccttacgttaacgaagtacgtaaacgtacgtacgaccgtaaggagtacggtacggacgtacgacgttagtagttcgtattacggtggtaccgagtagtacgggaacgtggtaacggtagggttacgtacgggttggagggtggtaccg

SEQ ID NO: 6133 - DNA, 987 bp, Homo sapiens
  misc_feature: GYAE6OF01EE4UE.24.76.G10.1.454.CMB.1.raw
  modified_base (251)..(251): a, c, t, g, unknown or other
  misc_feature (251)..(251): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggtagtttggcctgaacgttgggttttcctcgttgcttacttttaaggaggtcgtccagtcgtcaggtgcagcgtgggtggagtcggtgggggacggcggtcggtccagccgtggggacgtcccngacgactgtcctgtcgcgagcgtcgtaggacctactacttcctttacaaacgttaccgtagtcggacctagtcgacctacggttccggggccccaccggacgggtcctacccggaaggggaccggtaaaggggggtccttaggggtagggttcgggggttaggtacgtttaaggttttaggtttttagggtttaggtaacgttaacggggtaaaactttaacgacggttaaaatttaccgttaagtcggtaacgtaaacggggtacggttccccggggtaaagggtaaccgggggttaaccccgttaagtttaaccgtaacccgttaaccgtttaaccccgtaacccggtaaacggtaaccggtaaaacccgttaaacggtttaccccggtaaaagggttaacggttttaaacgtttttaacggtttaaccgttttaccgtttaacggtaaacgggttaaacttaaccgggtaaacgttaaccggtacccggttaaggtaaccgggttaaacgggttaaccgggtaaacggggttaacccggtaaccgggtttaaccgttaacggttttaacgggtttaaacgttttaaccggtttacggggttaacgggttaaccggttaaacggtttaaaacgggtaaaaccgggttaaggggtaaacggggttaacggggttaaacggggttttaccgggggtttaaacgggggttacgggggttacgggggttaaacccggg

SEQ ID NO: 6134 - DNA, 838 bp, Homo sapiens
  misc_feature: GYAE6OF01CTB89.24.76.G10.1.454.CMB.1.raw
  modified_base (329)..(329): a, c, t, g, unknown or other
  misc_feature (329)..(329): n is a, c, g, or t
  modified_base (691)..(691): a, c, t, g, unknown or other
  misc_feature (691)..(691): n is a, c, g, or t
  modified_base (817)..(817): a, c, t, g, unknown or other
  misc_feature (817)..(817): n is a, c, g, or t
tcagactactatgtcacgaccggtgctcgatttagtcactcatacgagggggggagaggagcccagcactagaagtcggcggttgtttccagttcggtgatcagcactgaacacagagactcaccagtggtagtttcggcctaggtaaccgtttggggtttttccctcggtttcgtctttacgtttttaaagggaggttcgtccgtaggttgttacgaggtgcaggtcgtggggtggtaggtcggtggggggacggtcgtggtccgaggcccggtaggggacggtcccgtaggaacgtcttcggtccgtggtgaccgaggtcgttacgngacctactacgtttctacaaaccttcgtaagcgactgcgtaccgtacgggttcccgggccgaccgaccggttcccgacggaacgggaccgggtaaggggtcgtagggggtacgggttgggggtacgtaggtttaaggtttttaggttttaggggttactaacgggttaaggaaaaacttttagtaacggttaaactacgttaggtaccggaacggtaacggtttacgggtacccgggtaaggggtaaaccgggtccttacgtttaacccgaccgttacggttaccaaccccggtaaagtaacctaaacgttacgaaacgggtaaggtttaattacgttttagaactttccgtaagaagttanacggttacgacgtcgggagaacggtacgaacgggctaacgtacggttacttagttacgtaacgtcggtacggacggtataaggtaaacgggcgtaaagggtaggggtcttaaacggggttacgggnggttaaaggggtgggtaaacc

SEQ ID NO: 6135 - DNA, 795 bp, Homo sapiens
  misc_feature: GYAE6OF01EARLC.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagctggtggagtcgtgggggagtcgtggtccagccgtgggacgtccctgagactgtcctgtgcagtccgtcgtggacactacttcttacaattacctagtggctagtgctaccggtcgggtccccaccgacggtcctaccggagggtaccggaagggggtccgtaggggagggttgggggtacggtacgtttaagggttttagttttggggttagtaacgttacgggtaaaacctttaagttaaggtaaaactttacgttaagtcggaaccgtaacgggtaccgggtttcccggaaggggtaaaccgggttacccggttaactttaccccgaacccgttacgttaccccgttaaccgaaacgggtaaaccgtaaaccttaaacggttacccggtaaagggtttaacgttttaaagtttttacgtaaccgtttccgttaaccgtaagttaacccgtaacggtaaaccgtaccgtaccgtaggaaacggtacgtaacggacggtaacgtacgtacgttagttacgtacgtttacgtggtacggtacgtaaggtaggaaaccggtggaacgggtagtacgggtttacgggtacggtagggtagggtacg

SEQ ID NO: 6136 - DNA, 880 bp, Homo sapiens
  misc_feature: GYAE6OF01ANA9A.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaaggaggtgtccaggtgtcgaggtgcagtcgtggtgggagtcggtggggggacggtcggtggtccgaggtccggtgggggaacggttcccgtggacggtaccgttcggttcccgttggtcggccgtacggtccggttccgttacggggaaccctaaccgtacttacctttaaccaaaacgttacccgttagtcggactagtcgtaccgtaccggtccggggtcccgaccgtacgggtccctaccggaggggtaccgaacggggggtcgttacgggggtagggttgggggtcggtacgtttaagggtttttaggtttagggtttaggaacggttaagggttaaaaccttaaaggttacggtaaaacgtttacgttaaggtacggtaacgtaacggggtacgggttacccggggtaagggtaaaccgggtacccgtttaacgttacccctaacccgtaacgttccccgtaaccggaaacgggtaacccggtaaaaccgttaacggttacccggtaaagggtttaaacgtttttaaggttttaccgttacgttacgttacgtaaggtaacgtacgaaaccgtacgtaccggtaggaacggtaccggtaggacggtacctaggtacttagtacgttaacttgtaggtcgtaggtaagtaacggtaaacggaggtagggggtaacggtaggttacgggagggtaggggttggtaaccgg

SEQ ID NO: 6137 - DNA, 724 bp, Homo sapiens
  misc_feature: GYAE6OF01BR8CY.24.76.G10.1.454.CMB.1.raw
  modified_base (188)..(188): a, c, t, g, unknown or other
  misc_feature (188)..(188): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
  modified_base (652)..(652): a, c, t, g, unknown or other
  misc_feature (652)..(652): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtncagctgggtggagtcgtgggggagcgtggtccagccgtgggacggtccctggacgtacgttgtcctgtgcagcgtcgnggacncattctacaatccttanggctagtgccacggtcgggtcccgaccgtaggccctaccgaggggtaccggaagggggtctggggaggttggggtacgcgtttaaggttttacggttttgggttacgaaggttaacggtaaacttaaagtggtaaaatttaccgtagtcggaactagggtaccggttccggtaagggaaccgggtaccttactttacccgaaccgttactaccgtaccgtaagtaaccgtaactaacgttaccgaaaggttaacgtttaagttttacgtactttacgttaacagtaacgttacgaaacgtcgtaaccgtaggtacggtacggtacggacggtaacgtaccgtgttaagttacgttactttacgnggttacgacggtaataacggtaaacgcggaaagggtaggttacggtagggtacgggtagggtacggtacggg

SEQ ID NO: 6138 - DNA, 713 bp, Homo sapiens
  misc_feature: GYAE6OF01B2R4V.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctgttgctcttttaagaggtgtccagtgtcaggtgcagctggtggagtcgtgggggaggcgtggtccagccgtgggacgtccctgagtactggtcctgtgcaggcgtcgtggacacattcctacaaactacctatggacctatcgacctacgtcgggtccgccgaggcctaccgaggaccgaggggctagggaggtcgggtgcttaggtttagttttgggtttagagttaggtaaacttaaggtacgtaagtttacctagtcggaacgtaggtacggttacccggaggaaccggggtcccgtaagtttcccaacccgttacgttcccgtaacgaaggtaaccgtaaacctaacgttacccgaaagggtttaacgtttaacgtttttcggtaactttccgtaagtacggtaattaccggaaacgtccgtccggttaaggtaccgggtaacggttccggaaacggtacccgtacggtacgtttagtaccgtttaagtaagttcgggtacgacgttaagtaaggagacggtaagggtgtaacgtttaggggcgttaggcgggtacg

SEQ ID NO: 6139 - DNA, 728 bp, Homo sapiens
  misc_feature: GYAE6OF01BS6I9.24.76.G10.1.454.CMB.1.raw
  modified_base (177)..(177): a, c, t, g, unknown or other
  misc_feature (177)..(177): n is a, c, g, or t
tcagactactatgtcacgaccggtgctcgatttagtcactcatacgaggggggggagaggagcccagcactagaagtcggcggtgtttccattcggtgatcagcactgaacacagagactcacagtggtagtttgcctgtaacgttgggtttttcctgttgtcttacttttaaaggnggttcgtccaggtgtcgtaggtgcaggcgttgggtgggtacggtcggtgggggacggtcgttaggtcccaggtcccggtggggtacgttcccgtaggacgtaccgttcgtcctggtcgacaggtccgtcaggactactacttctaacaacgttacctagtcgactagtcgtaccgtacggtcgggtcccgaccgacggtcccgtaccggacgggaccgggtaacggggcggtacggggtagggtaggggtcgttacgtttaggttttaggttttggttaaggtaagttaacggtaaacttaagtacggttaaacttacgtagacgtacgtaaggtacgtacggtaaggaacccggttctaacgtaccaccgtactcgactaaagaactaacgtaccgtaacgtaaggttaactttagtttacgtacttcgtagtacgatagacgtagacgtaggtacgtacgcgaacggtacgagtattgtaagttatagtgtacggtactagggtagaacgtaggtacggtaggtacggttggtagggtacggtggtacg

SEQ ID NO: 6140 - DNA, 629 bp, Homo sapiens
  misc_feature: GYAE6OF01B1H5U.24.76.G10.1.454.CMB.1.raw
  modified_base (190)..(190): a, c, t, g, unknown or other
  misc_feature (190)..(190): n is a, c, g, or t
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
  modified_base (356)..(356): a, c, t, g, unknown or other
  misc_feature (356)..(356): n is a, c, g, or t
  modified_base (402)..(402): a, c, t, g, unknown or other
  misc_feature (402)..(402): n is a, c, g, or t
  modified_base (595)..(595): a, c, t, g, unknown or other
  misc_feature (595)..(595): n is a, c, g, or t
tcagactactatgtcacgaccggtgctcgatttagtcactcatacgagggggggagaggagcccagcactagaagtcggcggtgtttccattcggtgatcagcactgaacacagaggactcaccagtggagtttggcctgaacttgggttttcctcgttgcttcttttaagaggtgtccagtgtcaggtncagtcgtgggtggagtcggtgggggagcgtggtccaggcctggggacgttcccngagacttcgtcctggtcgcagtcgtctcggacactatcgttacaatacctagtggcatcgactacgtcgggtccncgtaggcctacgaggccaaggggtctagggagtgggngtctagtttagtttggttagagttagaacttaagtgtaatacgtanggacaggtacgtccggaaggaacgggcctaatccgacctgtaccgtacgagtaacgaacgtaacgttaccgaaggtaacgttaattttggacttacgttacagtactacgaacgtacgtccgtagacgtaggtacggaacggtacgacgtacgttaagtacgttagtacgtagtcggtacgaagtgaaaccgngaacggttaggcgttaggtaggtagggttggacg

SEQ ID NO: 6141 - DNA, 784 bp, Homo sapiens
  misc_feature: GYAE6OF01CJTKL.24.76.G10.1.454.CMB.1.raw
  modified_base (724)..(724): a, c, t, g, unknown or other
  misc_feature (724)..(724): n is a, c, g, or t
tcagactactatgtcacgaccggtgctcgatttagtcactcatacgaggggggggagaggagcccagcactagaagtcggcggtgtttccattcggtgatcagcactgaacacagaggactcaccatggtagtttggcctgtacgttgggttttcctcgttgcttcgttttaaggaggttgtccagtgtcgaggtgcgtaggttgggtggtagtcgggtgggggacgtcggttcggtaccgacggtcccggtggggtaccggttccctaggacgtaccgttcggtcccgtggtcgaccgtaggtccggttccgtacgggaacctaacgtactttaccttaacaaacgttaacccgtagtcggacctagtcgaccgttaccggttcggggcccgaccggtacggtcccgtaccggaacgggtacgggaacggggtcggttggggacgggttggggtacggtacgttttaaggtttcggtttggttagaaagtacgtaaagttaacgttagtaaattacgtgtacgacggtaaggtaccggtcggaacgggtacggacccgttactaccaccgtactccgtaaccgaagccgtaaacgtacgtacggaagttaatttagtttcgtactacgtactaggtactacgacgtagccgtagacgtaaccggtgaaccggtactagggtacttaggttaaccggttattacggtggtaacgtacgggtaanaagggtaacgaagggtaaggttacgggtacgttagggtacgtaggggtcgtcggttacgg

SEQ ID NO: 6142 - DNA, 700 bp, Homo sapiens
  misc_feature: GYAE6OF01B9YDJ.24.76.G10.1.454.CMB.1.raw
  modified_base (613)..(613): a, c, t, g, unknown or other
  misc_feature (613)..(613): n is a, c, g, or t
  modified_base (637)..(637): a, c, t, g, unknown or other
  misc_feature (637)..(637): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaacttgggttttcctcgttgcttacttttaaggaggtgtccagtgtcgaggtgcagcgtggtggagtcggtggggagcgtggtccaggccgtgggacgtcctaggagacttcgtccgtgtacgtcaggtcgtacgtcggactactattccgttacaaacttacctagtcggacaattcgaccgtaccggttcgggcccgaccgacggtccctaccggaggaccggaaggggctaggggtaggttcggggtgtacgttaggttttcgtttgggttacgagtaacggtaactaaagtaggtaacttacgtaagtcgagtaacggtacgggttaccggtagggaaacccggtcgttaactaccgacctacgtcctacgaaagactaacctacggtaacgaaggtattaagttttagtactcttaagacgtaataacgaactcgaacgtgaagacgtacggaagaccgtacgtagttntagtaccgttaagtcgtcggtaanaggttaagaaacgtcggaaacgggttaggttaacggttgggttacggaaggttcggggtaacg

SEQ ID NO: 6143 - DNA, 746 bp, Homo sapiens
  misc_feature: GYAE6OF01CC7XD.24.76.G10.1.454.CMB.1.raw
  modified_base (265)..(265): a, c, t, g, unknown or other
  misc_feature (265)..(265): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgtctcttttaagaggtgtccagtgtcaggtgcagcgtggtggagtcgtgggggagcgtggtccagccgtggggacggtccctgacgactcgtcctgtgcgagtcgtcnggacacatcttacaatacctagtgacatgctacgtcgggtccgccgaggtcctaccgagggccgaaggggcgtagggacggtcgggggtaggtaccgttaggtttacggttttgggtttaggtaacgttacggttaaactaaagttagtaacgtttaacttaggtagacgtaggtacggtaccgggtaggtaccggggacttacgttaccgacctagttacctacgaacgaacgtaacgtaacgttacggaacggtacgttaagttttagtacttaccgttagtagttaagtaacgtaacgtacgtaccgtaggaacgtcggtaaccggacgtaacccggtagtacccgttaagttaggttaaccgtttaacggtcggttaacgtacggttaacggtaacggtaaacgggtaacgggaacgggtaaaggggtaacgggtttaccggggtaaacgggttgggggtacggggttaaaccgggg

SEQ ID NO: 6144 - DNA, 781 bp, Homo sapiens
  misc_feature: GYAE6OF01B4AQ4.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctgttgcttcttttaagaggtgtccagtgtcaggtgcagctggtggagtcgtggggagcggtggtccagccgtagggacggtccctgagactgtcctgtgcagcgtcgtaggacactacttctttacaactacctagtgcatgaccacgtcggggtcccaccgagggtccctacccggaaggggacgaaggggggtaccgtgggggtaggttcgggggtagtcggttaagttttacggttttggtttaggagttacggaaacttagagtaacttaaacgtgtagacgtagtacggttaccggtaaggaagggtccctaatttcccgaacccgttaattccgtaacccgtaagggaacgttaaactaacccgttacggaaagggtttaacgttttaagtttttacggtaactttccgttacgtaaaggttacgaaccgttaacgaaccgttaccgggttaggaagtaacggggttaccggaaaggttaccgaacgggttactttaacgggttacggtttaacctttaacggggtcgggttaagtaacgggttaacggtaacggaaaacggttagaacggggggtacggttaacgggtttaggggtaaagggttcggggtaagggtaaccggg

SEQ ID NO: 6145 - DNA, 746 bp, Homo sapiens
  misc_feature: GYAE6OF01AZP0H.24.76.G10.1.454.CMB.1.raw
  modified_base (704)..(704): a, c, t, g, unknown or other
  misc_feature (704)..(704): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggagcgtggtccagccgtgggacgtccctgacgactcgtcctgtgcgagcgtctcggacactacttccttacaacttacctagtcggcatcgactaccggtcgggcccgccgacggtcctccgagggaccggaagggggtctaggggtaggtcgggtacggtacttaggtttttaggttttgggttacgtaagttacgggtaaacttaagttaggtaaacttacgtacgtaggacgtaagggtaccggttccgggaagggtaaccggggtaccctaactttacccgacccgttacgttacccgaaccgtaaggtaaccgtaaacgttaacccgttacggtaaaggggttaacctttaaaggtttttacgtaacttttaccgtaacgtaaggttacgtaacggaaccgttcgtacccggtaggtaacggtacggttacggaacggtaccgaggttacttagttagttacgttgtacggtcgaagtaggtaacgaacggnggtaaggtaggttacgttaggggtacgtagggtacggtaccg

SEQ ID NO: 6146 - DNA, 923 bp, Homo sapiens
  misc_feature: GYAE6OF01DSWTW.24.76.G10.1.454.CMB.1.raw
  modified_base (460)..(460): a, c, t, g, unknown or other
  misc_feature (460)..(460): n is a, c, g, or t
  modified_base (514)..(514): a, c, t, g, unknown or other
  misc_feature (514)..(514): n is a, c, g, or t
tcagactactatgtcacgaccggtgctcgatttagtcactcatacgagggggggagaggagcccagcactagaagtcggcggtgtttccattcggtgatcagcactgaacacagaggactcaccagtggtagtttcggcctgtaacgttcggggtttttcctcggtttgcctttacgtttttaaaggcgggttcgtacccgaaggttcgttaccgtaggggttgccaggtcgttggggtaggacggttcgggtgggggggacgtccggttgggtcccaggtcccgttgggggaaccgttcccgtggacgactttcggtcctaggtcgaccggtacgcggtttaccaggaacctacttacttaccgttaacctaaacttaaccttaggtcggacagtacggtcctacgggttcggggtccccacgacgggtccgtaccgacggggtaccgaacggggggtnttagggggtgggttcggggtcggttacgttaggtttttaacgttttggggttanacggttagggtaaacttaagtaacggttattaacgagttgacggtacgtaacgggttccggtaagggtaaccggggacccttacgttacccgacccgttaacgttaccccgacccggtaaacggtaccgtaaaccgttaaccggttaacccggtaaggggtttaaccgtttaaacgtttttacgggttaacctttacggtttaaccgtacggtaaagttaccggtaaacgtacccgggtaacgtacgggtaacgggtaaccgttaaccgggtaacgggtacccggttacgtaacggtttacgttaacggtttacgttacgttacgggtcggtaaccggttaaagcgggtaaacgtaagggggacggttagggtaacggttagggttacggggtaggtcggggttacggg

SEQ ID NO: 6147 - DNA, 739 bp, Homo sapiens
  misc_feature: GYAE6OF01CL5W4.24.76.G10.1.454.CMB.1.raw
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (438)..(438): a, c, t, g, unknown or other
  misc_feature (438)..(438): n is a, c, g, or t
  modified_base (725)..(725): a, c, t, g, unknown or other
  misc_feature (725)..(725): n is a, c, g, or t
tcagactactatgtcacgaccggtgctcgatttagtcactcatacagggggggagaggagcccagcactagaagtcggcggtgtttccattcggtgatcagcactgaacacagagactcaccagtggagtttggcctgacgttgggttttcctcgttgcttcttttaagaggtcgtcctagtgtcaggtcgcaggcgtgggtggacgtcggtgggggaggtcgtggtccgagccgtggggacgtccctgacgcgttgtcctgtcgcagcgtcgagaccactattctacaacttacctancganatcgcgtacgtcggggtcccaccgtaggcctacccggaggaccggaaggggtccgtaagggtgggttcggggtgtacgttaagggttttgttttaggttagtaagttacggtaaactaaagtgtaaaactgtagngtacgacgtcggttcgaagggtaacgggtacctacgtaccaacccgtactacctaaccgaaggtaaacctaaccgaacgttaaccgtaaaggttaacgtttaaattttacggttaacttaccgtttagaaacggttaccttaaacgtaaccgtacggttacgtacggtaacgggtacggaaacggttacggaaccgtaacggtacttaagttacgttaccgttacgttggacgtaaggtagtaaacggaaggtacgggaaaggttacggtaaggtaggttaacgggngggttaccgggtag

SEQ ID NO: 6148 - DNA, 853 bp, Homo sapiens
  misc_feature: GYAE6OF01D46LQ.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccagtggagtttggcctgaacgttgggttttcctcgttgcttcgttttaagaggttgtcctagtgtcgaggtgcagcgtggtggagtcggtgggggaggcggtggtccgaggccgtggggacggtccctgacgtactgtccgtgtgcgagcgtcgtgaccactacttccttacaaacttacctagcggacagtcgctacggtcgggcccgccgacggccgtaccggagggtaccgggaaggggtccgtagggggtagggttggggtcgggttacgtttaagggttttaggttttacgggtttaggtaaacgttaaggggtaaaacttaagttacggtaaaactttaaggtaacgttgaacccggtagggtaaccggttccgggtaagggtaaccggggtaccgttaaccgttacctaacccgttacttaccggaacggtaaacgtaacccgttaaaccgtaaacgtttaccgggaaagttaaacgtttttaacgtttttacgtaaccgttttacgttacgggaaaagttttacggaaaccgtaaccgtaccggttataaccggggtaaagggtacggggtaacccgaaaccgggtacctaaacgggttctttaaacggtaccggtttttaagtacccgggttagtcgggttaaaacggaggtttaaaggaaacccgggttggaaacgggttacggttagtcgggggttaaacggtggggtcgggttaacccg

SEQ ID NO: 6149 - DNA, 1010 bp, Homo sapiens
  misc_feature: GYAE6OF01AE2P7.24.76.G10.1.454.CMB.1.raw
  modified_base (532)..(532): a, c, t, g, unknown or other
  misc_feature (532)..(532): n is a, c, g, or t
  modified_base (658)..(658): a, c, t, g, unknown or other
  misc_feature (658)..(658): n is a, c, g, or t
tcagactactatgtcacgaccggtgctcgatttagtcactcatacgagggggggagaggagcccagcactagaagtcggcggtgtttccattcggtgatcagcactgaacacagacggactcacagtggtagttggctagaacgttcgggttttccctcgttgtctttacgttttaaggaggttcgtacctaggttcgtcgagggtcgcgtaggtcgttggggtcgggtacggttcgggtgggggggacgggtcggtcgggtaccgagggtcccggtagggggacgttcccgtaggaccggtcttcggtccgtggtcgacgtacggtccgtacgtacggacctacgtactttactaccgtaacttaccgtggtcggatacgtcggtaccgtccggttcccggggtcccgacccggtacggtcccgtaccggtaacggggaccggggtaaccggggtcgggtttacgggggacgggggtttcggggttacggttacccggttttaggggtttttaacggttttagggggttanaacgggtttaagggtaaaacttaaggttacgttaaaacgttacgtacggtcggtacggtaaccggttacggggttaacccgtaaggggttaacccgggtccttaaccgtacccttaacccgttacnccccggtaacggtaacggtaacccggtaaaccgttaacggttaaccggaaaggttttaacggttttaaccgtttgttaaccgtttaacgtaccggttaagtaaccggtaacggtaacccgttacgggtacggttaacgggaacgggtttaccgggaaccggttaaacgggttaacccgtacgggttaaccggtttaccggttaacgggtttaccgttacggggtcgggttaaaccggttaacgggttaaagggtaaaccccgggaaggggttaaacggggtacgggggtttaacgggttacgggggttagggtttacccgggggttaaagggttcggggtttaaaccccggg

SEQ ID NO: 6150 - DNA, 730 bp, Homo sapiens
  misc_feature: GYAE6OF01CN1IN.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggttgtccagtgtcaggtgcagcgtggtggagtcgtgggggagcgtggtccagccgtgggacgtcctgagactgtcctgtgcacgcgtcgtgactactatcttacaactacctagtcggacagtcggctaccgtcgggtcccgccgaaggtcctaccgaggcgaagggggtctgggtaggtcggggtgacgttgtttagttttggttagagttaggtaaacgttaaagtaagtaacttacgtagtagtacgtaggtaccggttaccggaggtaaccggggacccgtagtttacccgaccgtaacgtcccgtaccgaagaaccgaaccgtaacgtaccgaaagggttaagttaaattttcgtaacgttccgttaagtaggtaacttaacggaaaccgtcggtaaccgtgtaaccgggtaggtaacggtaacggtaccgaccggttaacgttacgttagttaaccgttagttagggttacgacgggttaaggtaaccggtaagtaaccgggtaagggtagggttaacggttaggggtagggttacggggtagggttaaccgg

SEQ ID NO: 6151 - DNA, 798 bp, Homo sapiens
  misc_feature: GYAE6OF01C6EJI.24.76.G10.1.454.CMB.1.raw
tcagactactatgtcacgaccggtgctcgatttagtcactcatacagggggggagaggagccagcactagaagtcggcggtgtttccattcggtgatcagcactgaacacagaggactcaccatggagtttggcctgaacttgggttttcctcgttgcttcgttttaagaggtgtccagtgtcaggtgcagtcgtgggtggaggtcggtggggggaggtcggtggtccaggccgtggggtacggtcccgtggacgtaccttggttccgtggtcgctacggtccgttcgtacggaactactattccttaacaacttacccttagtcggactagtcggaccgtaccggttcggggtcccgccgtacgggtccgtaccggacggggtacggaacgggggtcggtagggtacggggtggggtaacggtcgtttaagggttttaggttttcgggtttaggacgttacggtaaacgttaagtaacggtaaacttacgtagtaggtaccgtagggtacgggtaccgggttaagggaaaccgggttccgtaacgttaccgaacctacgttacctaccgtaacgaaacgtaaccgtaaacgttaccggaaaggtttaacggtttaactttttacgtaccgtttacgttacggtaacgtacgtaaccggtaacgtacgtaccggttaggtacgggtacggtaccggaacggtaaccgtacggtacgttaagttacgtacgttcgtaggtcgacgtaggtaacgaacggcggtaaagggtgggttacgtagggtcggagggtggtacgg

SEQ ID NO: 6152 - DNA, 649 bp, Homo sapiens
  misc_feature: GYAE6OF01CSM4O.24.76.G10.1.454.CMB.1.raw
  modified_base (84)..(84): a, c, t, g, unknown or other
  misc_feature (84)..(84): n is a, c, g, or t
  modified_base (155)..(155): a, c, t, g, unknown or other
  misc_feature (155)..(155): n is a, c, g, or t
  modified_base (160)..(160): a, c, t, g, unknown or other
  misc_feature (160)..(160): n is a, c, g, or t
  modified_base (173)..(173): a, c, t, g, unknown or other
  misc_feature (173)..(173): n is a, c, g, or t
  modified_base (192)..(192): a, c, t, g, unknown or other
  misc_feature (192)..(192): n is a, c, g, or t
  modified_base (570)..(570): a, c, t, g, unknown or other
  misc_feature (570)..(570): n is a, c, g, or t
  modified_base (587)..(587): a, c, t, g, unknown or other
  misc_feature (587)..(587): n is a, c, g, or t
  modified_base (593)..(593): a, c, t, g, unknown or other
  misc_feature (593)..(593): n is a, c, g, or t
  modified_base (610)..(610): a, c, t, g, unknown or other
  misc_feature (610)..(610): n is a, c, g, or t
  modified_base (639)..(639): a, c, t, g, unknown or other
  misc_feature (639)..(639): n is a, c, g, or t
tcagactactatgtcacgaccggtgctcgatttagtcactcatacgagggggggagaggagcccagcactagaagtcggcggtntttccattcggtgatcagcactgaacacagagactcaccatggtagtttggcctagacgttgggttttccncgttncttactttaaggnggtcgtccagtgtcaggtncgagcgtgggtggaggtcggtgggggacgtcgtggtaccagggtccgtgggggaccgtccgtaggaacgtcgttcgtcctggtgcaggtcgtcgagtaacactacttcttaacactaccgttgtacgatagtcgtaccgacggttccgggccccgaccgtacgtccgaccggaacggaccggggaagggtcgtaggggtagggtcgggtagtacggttagttttaggtttggttagaaacgtaagggtaaattaggaaattagtactgtcgaacgtagtacggtacggtagtaaaccggcgttactaccgactacgtcgaacgagaactaacgtaacgtacgagttagttattctattacgagtacgataagacgtancgtagagtgacgatagntgttangttatcgaggcgtaagngtaacgaggagagtcggtagtgggtacgnggtcggtacg

SEQ ID NO: 6153 - DNA, 662 bp, Homo sapiens
  misc_feature: GYAE6OF01AT7BQ.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctggggaggtccctgagactgtcctgtgcagcgtctggacacatcttcaatacctatggcatgcacgtcggggtcccgccgaggcctccgagggccgaagggggcctgggaggtggggtggctaggtttagtttggttgagttggaaactaatgaatactatgcaggagtccggtaggaacgggtccgtaattcccacctacttcctacccgaaggtacgaactaacgttaccgaagggtacgttaattttcgtaacttctttacaaggtactaggaactagtacccgtaggaacggtacggtacggaacggtaaccgtaccgggtacttagttacgttaacgttacggtacggttacggtaccggtaagttaacgggaaaacggtcggaaggggtaacgggttaggttggggtttaacgggtagggttacgggggtacgg

SEQ ID NO: 6154 - DNA, 683 bp, Homo sapiens
  misc_feature: GYAE6OF01BNC53.24.76.G10.1.454.CMB.1.raw
  modified_base (169)..(169): a, c, t, g, unknown or other
  misc_feature (169)..(169): n is a, c, g, or t
  modified_base (503)..(503): a, c, t, g, unknown or other
  misc_feature (503)..(503): n is a, c, g, or t
  modified_base (539)..(539): a, c, t, g, unknown or other
  misc_feature (539)..(539): n is a, c, g, or t
  modified_base (552)..(552): a, c, t, g, unknown or other
  misc_feature (552)..(552): n is a, c, g, or t
tcagactactatgtcacgaccggtgctcgatttagtcactcatacgagggggggagaggagcccagcactagaagtcggcggtgtttccattcggtgatcagcactgaacacagagactcaccatggagtttgcctgaacgttgggttttcctcgttgcttctttaagnggttgtcagtgtcaggtgctagcgtggtggaggttcgtggggggacgcgtgggtccaggtcccgtggggaggtcccctggacgtacttgtcctggtgacgtagcgttcgtaggactacgtattccttaacaagttacctagtcggcaagtcgaccgtacggttccgggtaccccgccaacgggtccctaccgaggggaccgtaacgggggtctaggggtgggttgggaccgggtattaggttttaagttgggtttagaagtacggtaaactagtagaacgtcgtaatcggacgtaggtacgtccggtaggaacgggtccctattaccaccgtanccgtacagtaacataacgtcgaaggtattaacgttnttacgtacgttanacgtagtaacgtagacgtactggacgtaggtacggacgttaccggacctgacgttagtaccttggtacggttcgacgtaggtaaccaggtacgtaagggaaggttagtaggggtaccggtggttacggacg

SEQ ID NO: 6155 - DNA, 993 bp, Homo sapiens
  misc_feature: GYAE6OF01AU3MW.24.76.G10.1.454.CMB.1.raw
tcagactactatgtcacgaccggtgctcgatttagtcactcatacgagggggggagaggagcccagcactagaagtcggcggtgtttccattcggtgatcagcactgaacacagagactcaccagtggagtttggcctgtaacgttgggttttcctcgttgtccttcgttttaaggcggttcgtacctaggtgtcgagggttcgcgtaggtcggttggttggacggttcggtaggggggacgtcggttcggtacccaggtcccgtggggtacgttcccgtaggtacgtacgttcggtcccgttgggtccgacgtacggttccggtaacgtacgggaccctacgtcgttaccttaccgaagttccgtagcggactagttcggacctacggttcccgggttcccgaccgtaggtaccccgtccggtaacgggacgggtaacggttcggccgggttaagggttccggggtactaacccgggtttaggtttttacggtttccggtttaaggtaacggttaaccggtaaaaacgtttacgtaacggttaaacttttaccggtaacgttaggtaacccgggtaagtttacccggggttaccggggttaaacggggttaaaccgggggttccccttaaaccgtttaccccgggtaaaccgggttaaccccgtttcccgggttaaaccccgtaaaggggttaaaacccccctttaccgggtttaaaacccgggtttcccgggtaaaaagggtttaaaacggttttttaccccggtttttaaggtaaacccgtttttacggttaaaccggaacgtttaaacgggttaccgtaaacccgttttaaccgggaacggtttacggaaacgggggtttaactacccgggaaacgggtttccaaccgggttactttaaggtaccgttttaccgtacggttacgggttccgaaggtacgttaacgggaacgtaggtaggtacgggtattcgggttacggaggtagtcgg

SEQ ID NO: 6156 - DNA, 819 bp, Homo sapiens
  misc_feature: GYAE6OF01CBRAI.24.76.G10.1.454.CMB.1.raw
tcagactactatgtcacgaccggtgctcgatttagtcactcatacgagggggggagaggagcccagcactagaagtcggcggtgtttccattcggtgatcagcactgaacacgagaggacctcaccatggtagtttggcctgtaacgttcgggttttcctcgttgtcttcgttttaaggaggtcgtccgtagtgtcaggtgcagtcgtggtggaggtcggtgggggacggtcggttcggtacccgacggtcccggtacggggtacggttccccgtaggacgtaccgttcgttccgtggtcgcgtacggccgtacgtaggactacgtactttaccgttaactaacgttacccgttacgtcggtacctagtcggaccgtaccggtccgggtcccgaccgacggtccctaccggacggtaccgggaggggtcgtaggggtacggttcggggtcgtacgttagggttttacggttttgggtttagtaagtaacggtaacttaagtagtaaacttacgtagtagtaccgtaggtacggtaccgtagggtaacggtaccgtacgttacccaccgtaccgtccgtaacgtaacggtacgttaaccgtaacgttaacggtaagggttaatttaacggtttacgtacgttcttaacgaagtaacgtaacggaacttcggacgttaggtaacgtacggtacggacgtaccggtacgttgtaggttagttacgttacggtaggtacgtaggtaacgttcggaaaacgcggggttaaacgggtacggttaaggttaccggggttaacggtaacggggttccggtaaccggg

SEQ ID NO: 6157 - DNA, 836 bp, Homo sapiens
  misc_feature: GYAE6OF01DECE8.24.76.G10.1.454.CMB.1.raw
  modified_base (184)..(184): a, c, t, g, unknown or other
  misc_feature (184)..(184): n is a, c, g, or t
  modified_base (552)..(552): a, c, t, g, unknown or other
  misc_feature (552)..(552): n is a, c, g, or t
  modified_base (816)..(816): a, c, t, g, unknown or other
  misc_feature (816)..(816): n is a, c, g, or t
  modified_base (825)..(825): a, c, t, g, unknown or other
  misc_feature (825)..(825): n is a, c, g, or t
tcagactactatgtcacgaccggtgctcgatttagtcactcatacgagggggggagaggagcccagcactagaagtcggcggtgtttccattcggtgatcagcactagaacacagacggactcaccagtggtagtttggcctaggtacttggggtttttcctcggttgtccttacttttaaggnggttctccgagttcgtcgaggtgcaggtcgtggggtaggtggtcgggtagggggggaggtccgggttcggtacccgtacgggtccgtaggggggtaccggttccccgtagggacttccgttcggtacccgtggtaccggcgtacggtcgttcggacggaacctacctaacttccttaaccgtaaaaccttaccgttaaggtccggatacggttcggaaccttaccgggttccggggaccccgaaccgtacgggtcccgtaccggacgggtacgggaacggggtcgttaggggaggtcggggtgagtttagggttttaggtttacggtaggaacgttaagggaaacttaaggtagaaactttcggtagnggtacgaaggtccggttacgggtacggaacgggtccttactaaccgtacctgttaacccgacggtaaagacgtaaactaaccggttacggtaaaagggtttcttttaaacgttttactaacgttctaacggtaaagtacggttaacaacccggtttggaccgtaggtaacgtacgtaggaacgtacgggacttaacggttactggtacttacggcggtaggttacaagttacgggaacgagggtacgggtagtacgggtaaggngggtaaggnggtttacccgg

SEQ ID NO: 6158 - DNA, 776 bp, Homo sapiens
  misc_feature: GYAE6OF01AK4PB.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagcgtggtggagtcgtgggggagcgtggtccagccgtggggacggtccctgacgtacctcgtcctgtgcacggtcgtcgtggacacgattccttacaacttacctagtcggcagtcgcctacgtcgggtcccacgacggtcctccgagggcgaaggggtcgtagggacggtgggtcgtacttaggtttagtttcgggttgtacgtaggtaaacttaagtacgtaaacgttactagtggaacgtacggtacgttaccgggtaggtaaccgggtcccgttaacgtcccgtaaccgtacgttccaaccgaaggtaaacggtaaccttaaacgtaccgggtaaacggtaacgttttaagttttacggtaactttaccgttaacgtaacggtaacttacgggaaaaccctcgggttacccgtaaggggtaacggtaaccggttaccggaaacggggttacccgtaaccgtcgtttaaacgttacggttaaccgtttaacggtggtaaacgacggttaaacgggttaacgaaacggtaacggaaggggttacggtcggtttaagggggtacgtcgggggttaggtaaccccgg

SEQ ID NO: 6159 - DNA, 917 bp, Homo sapiens
  misc_feature: GYAE6OF01B99RF.24.76.G10.1.454.CMB.1.raw
  modified_base (197)..(197): a, c, t, g, unknown or other
  misc_feature (197)..(197): n is a, c, g, or t
tcagactactatgtcacgaccggtgctcgatttagtcactcatacagggggggagaggagcccagcactagaagtcggcggtgtttccattcggtgatcagcactgaacacagaggacctcaccatggagtttggcctagacgtcgggttttcctcgttgccttcttttaaggaggttgtccagttgtacgtaggtncagtcgtggtggagtcggtagggggacggtcggtcggtccaggcccggttaggggaccggttccctgggtaacgtaccgttcggtacccgttggtacggcgtaacggtcggttcgttacgggaacctaccgtacttaccgttaacctaacgttacccgttagtacggactaacggtcgtaccgtaaccggttccggggtccccgtaaccggtacggtccgtacccggaacggggaccggtaacgggggtccggttaggggtaacggggttggggtaccggtacggtttaaggttttaggtttttacgggttacggttaaacggtacggttaaaccgtttaaaggtacggttaaacttacggttacgtacgtacgttaaacggaccggttaccgggtaaaggtaacccggggttaccttaaaccgttaccgtaaccctaacgtaccgttaaccgaaggttaacccgaaacgttacgtaaccggagttaacgtttaagttttcgtaagtttcgtaaccgtaagttaccgtaacgtaaccgtcgggtaaccctaggggtaccgttaaccggggtcgaaaccgggttaccgtaaccggttacttaacggtttacggtttaaccgtttaccggttgggtaaaccgttacggttaacggtaaacggttacgggaacggttacggggtacgtttacgggtacggtacgggttaggggacggtttacg

SEQ ID NO: 6160 - DNA, 878 bp, Homo sapiens
  misc_feature: GYAE6OF01E2EMT.24.76.G10.1.454.CMB.1.raw
tcagactactatgtcacgaccggtgctcgatttagtcactcatacagggggggaggaggagcccagcactagaagtcggcggtgtttccattcggtgatcagcactgaacacagaggactcaccatggagtttggcctggaacttgggttttcctcgttgcttcttttaagaggtgtccagtgtcaggtgcagctggtggagtcgtgggggagcgtggtccagccgtggggacgtccctgagtactgtcctgtgcgagccgtcgtggacacattccttacaaattacctagtggactagtcggcctaacgttcggggtccccaccgtaacggtcccttacccggaaggggtaccggtaaaacggggggtccttagggggtaacgggtttcgggggttacgggtacctttaagggtttttagtttttacggggtttacggaaagtttacggggtaaaacgttaaagttaggtaaaacgtttacgttaaaggtcggaacgtaacgggtaccgggtttacccgggtaagggtaaaaccggggtcccgttaaagtttaccccgaaccgttaaccgttccgtaacccgaaggtaaacgtaaaccgtaaacgtttaccgggaaaagggtttacgtttaaaacgttttttcggtaaactttcccgtttaacgaacgttaacgtaaccgggtaaacgtacggttacccggtaggtaacggttaaacgggtaccggaaacgggtaacccgtacgggttacgttaacgtttacgttaacgtttaacccgtgggttacgggtaaccgttaacggtaaacgggaaacggttacggtaacggggtaaggtacggtttaacggggttaccggtaaggggttccgggtaacgg

SEQ ID NO: 6161 - DNA, 731 bp, Homo sapiens
  misc_feature: GYAE6OF01DFRAV.24.76.G10.1.454.CMB.1.raw
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
tcagactactatgtcacgaccggtgctcgatttagtcactcatacagggggggagaggagcccagcactagaagtcggcggtgtttccattcggtgatcagcactgaacacagaggacctcaccatggagtttggcctgaacctgggttttccctcgttgccttcgttttaagaggtgtccagtgtcaggtgcagcgtggtggagtcggtggggggacgcgtggtccagccgtggggacggtccctggacgctgtccgtgtcgcagcgtcagactnatctacaacttacctagtcgcngtcncgtacgtcggtcccncgacgtccgtacgagggtacgaacggggtcgtaggggtaggttgggtaggtacgttaggttttacgttttgggttagtaacggtaggtaaacttaagtacgtaattacttagcgacgacggtacgtcggtaaggacggtccgtacgttacgaaccgttacttacccgacgtaaacgtacggaaacttacgtaaaccgtaaggttaacgtttaagttttacgttacttaccgttagagtaacgtaagaaccgtacgtaccggttaaggaacgggtacggtacggaacgggttaacccgaggttacgttaacggtttacgttaaacgtcggttacgtaacggtacttaaaggttaaaccggaaggtacgggaaggttaggtaacgggttgggttaacggaggggttcgggtaacgg

SEQ ID NO: 6162 - DNA, 838 bp, Homo sapiens
  misc_feature: GYAE6OF01EJERP.24.76.G10.1.454.CMB.1.raw
tcagactactatgtcacgaccggtgctcgatttagtcactcatacaggggggggagaggagcccagcactagaagtcggcggtgttccattcggtgatcagcactgaacacagagactcaccatggtagtttggcctgaacgttgggttttcctcgttgcttacttttaagaggtgtcctagtgtcaggtgcagtcgtggtggagtcggtggggagtcgtcggtccagccgtgggacggtccctagacgtactcgtccgtggtgcgtagccgtcgtacggaaccacgtacttcttaacctaaacgttacctaagtcggactaacgtcgaccgtaacggttccgggggtacccgaccggacggtacccgtacccggaaacggggtaccggtaaacgggggtcgttaggggtagggttcggggtacgggtacgtttaacgggtttttaggtttttacgggttaacggtaaacgttacggggtaaaaacttaaagttaacggtaaaagtttaccttaaggtaccggaacggtaaaacggtcgggtttaaccccgggtaagggaaaccgggttacccggttaactttaacccgaaccggttaaccttaccggtaacccgtaaaggtaaacgaacgtttaaacgtaccgggtaaaggttaaacgttttacgtttagtaactttcgttaagaacggttactaacgttaaacgaacgtacgtaaggtaacgtaacgggtacggtaacggacgttacggtagttaacgtagttaacttacgtagggtattaacggaaagtaaggaacgtacgaagggtactaggttaggtaggagggtcggtaacg

SEQ ID NO: 6163 - DNA, 952 bp, Homo sapiens
  misc_feature: GYAE6OF01BG2T7.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccagtggagtttggcctgaacttgggttttcctcgttgcttcttttaagaggtgtccagtgtcaggtgcagctggtcggagtcgtgggggagcgtggtccagccgtggggacgtccctgacgtacgtgtcctgtgacaggtcgttctaggacctacgtattctttacaattaccgtagtggacctagtcgacgtacgttcggggtccccaccgaggtccctaccggagggacggtaacgggggtcgtaggggacgggttcggggtaggtaccttagggtttttaagttttgggtttaggaaaggttacgggtaaacttaaggtagtaaacgttacgttagtacggtactaaggggtaccggtttacccgggaagggtaaaccggggtacccgttaactttaccccgtaaacccgttaaaccggtttcccgttaaccccggaaagggttaaacccgtaaaccggtttaaacctttaacccggggtaaagggtttaaacgttttaaaccgtttttttaggtaaaccgttttccgtttaacggtaaacggtttaacggtaaccgtaaacggtaaccggttaacccggtttaaggggaaaccggttaaccgggggtttaacccgggaaaggggtaaccccggttaacggggtttacccttaaaggttttaacccgggtttaaaccgttttaaccgggttaggggttaccgggtaaaccggtttaacgggttaaaagggggaaaacggttacccgggtaaacgggggtttaagggttaacgggtttttacgggggtaaacccggggtttagggggttacccggggttaaaccgggg

SEQ ID NO: 6164 - DNA, 765 bp, Homo sapiens
  misc_feature: GYAE6OF01EAXHQ.24.76.G10.1.454.CMB.1.raw
  modified_base (755)..(755): a, c, t, g, unknown or other
  misc_feature (755)..(755): n is a, c, g, or t
tcagactactatgtcacgaccggtgctcgatttagtcactcatacagggggggagaggagcccagcactagaaggtcggcggtgtttccattcggtgatcagcactgaacacagaggactcaccatggtagtttggcctgaacttgggttttcctcgttgtcttcttttaagaggtgtccagtgtcaggtgcagcgtggtggagtcgtgggggaggtcggtcggtccaggtccgtggggacggtccctggacgtacttcgtccgtggtcgctaggtcgtctcggaacactattccttacaaacttaccgtagtggctagtcgacctaccggttcggggtccccaccggtagggtccctacccggaaggggccggtaaggggggtccgttaggggtacgggttggggtagggtacgtttaaggtttttacggtttttgggtttacggaaggttaacgggtaaaacttaagtaagtaaactttacgttagtcgacgtaaggtaccggtaccgggtaaggaaccgggtcctaacgtttacccgaacccttattcccgtaacgaaggtaaaccgtacgtaaacgtttaccggaaaggttaacgtttttaagttttcggtaactttcgttacgaagtaacgtacgtaaacgacgtaccgtaggaacggtacggtaccggaacggacgtacggttacttagtacgtttatacggttgtcgaagtaataacggaaagcgaaagggtggtagtttggggacgngggttaggcg

SEQ ID NO: 6165 - DNA, 725 bp, Homo sapiens
  misc_feature: GYAE6OF01B3P9Y.24.76.G10.1.454.CMB.1.raw
  modified_base (570)..(570): a, c, t, g, unknown or other
  misc_feature (570)..(570): n is a, c, g, or t
  modified_base (609)..(609): a, c, t, g, unknown or other
  misc_feature (609)..(609): n is a, c, g, or t
tcagactactatgtcacgaccggtgctcgatttagtcactcatacagggggggagaggagcccagcactagaagtcggcggtgtttccattcggtgatcagcactgaacacagaggactcaccagtggtagtttggcctaggaacgttgggtttttccctcgttgcttcgttttaaggaggtgtccagtgtcgaggtgcaggcgttgggtgggaggtcggtgggggagtcgtggtccaggtccgtggggacgtcccgtggacgtacgttccgtccgtggtcgcgacggtccgttcgtacgggaccacttacgtttccttaacctaaacgttcccttaggtcggtactagtcgacccgtacggtcgggtcccgacccggcgggtaccgtccggacgggacgggtaacgggggtcggtaacgggtgggtacggggttggtacgtaggtttttaggtttggttagtagtacggtaaataagtagtaacttacgtacgtgacgtaggtacggtacgtggtaacgggtcgtacgtaccacgtacctcgtaccaagacgtaaccgtaactaacggngttaagtttagttagtacgttctagtacagaccgtaacncgtacgagacgtagacggaaggtactacgatttacggtattaccgttagtggttacgaagttaggagacgggacgaacggggttagagggttacgggtaggtacggtggttacggg

SEQ ID NO: 6166 - DNA, 713 bp, Homo sapiens
  misc_feature: GYAE6OF01C2AQX.24.76.G10.1.454.CMB.1.raw
  modified_base (194)..(194): a, c, t, g, unknown or other
  misc_feature (194)..(194): n is a, c, g, or t
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
tcagactactatgtcacgaccggtgctcgatttagtcactcatacgagggggggagaggagcccagcactagaagtcggcggtgtttccattcggtgatcagcactgaacacagaggactcacatggagtttggcctgaactgggttttcctcgttagtcttacgttttaaggaggtcgtaccagtgtcaggtncgagtctgggtggagtcggtgggggagtcgtcggtaccagccgtgggacgttcccngacgactgtcctgngaccgtgcgtctaggactactaacttcttacgaaacttactaagtggactaatcggacacggttcggacccgcgaacggtcctaccggaggaccggtaaggggcgtaggggtagggtaggtaggacgttaagttttacggtttggtttaagagtagggtaaactaagtaagtaaattacgtcttaacggactaagttacccgggtacggttaacgggaaaacggggtaccttaacgttaccaaccctagtaccctacggtaacgaagtaactaagttaacccgaaggtaagttaacttttagtacttactaagtactagtaacgaatacgtaccgtagtagggtacgtaacggtacggtacgaaccggtattaagtatacgttacggtgtaggtacgaagtaggaaaactggaacggtaacggtaggtagtaacggtgggtagggtacg

SEQ ID NO: 6167 - DNA, 714 bp, Homo sapiens
  misc_feature: GYAE6OF01DGKKT.24.76.G10.1.454.CMB.1.raw
  modified_base (167)..(167): a, c, t, g, unknown or other
  misc_feature (167)..(167): n is a, c, g, or t
  modified_base (399)..(399): a, c, t, g, unknown or other
  misc_feature (399)..(399): n is a, c, g, or t
  modified_base (441)..(441): a, c, t, g, unknown or other
  misc_feature (441)..(441): n is a, c, g, or t
  modified_base (469)..(469): a, c, t, g, unknown or other
  misc_feature (469)..(469): n is a, c, g, or t
  modified_base (569)..(569): a, c, t, g, unknown or other
  misc_feature (569)..(569): n is a, c, g, or t
  modified_base (596)..(596): a, c, t, g, unknown or other
  misc_feature (596)..(596): n is a, c, g, or t
  modified_base (609)..(609): a, c, t, g, unknown or other
  misc_feature (609)..(609): n is a, c, g, or t
  modified_base (704)..(704): a, c, t, g, unknown or other
  misc_feature (704)..(704): n is a, c, g, or t
tcagactactatgtcacgaccggtgctcgatttagtcactcatacgagggggggagaggagcccagcactagaagtcggcggttgtttccagttcggtgatcagcactgaacacagaggactcaccagtggagtttcggcctggtaacttgggtttttccctggttntcctttacgtttttaaggagggttcgtcctaggttgtcagggtgcagcgtgggtggaggtcggtggggggacgtcggtcggacccaggccgtggggaccggtccctaggaactccgttgtccttggcgaccgaggtccgttacgaggaaccactaattccgttaacaacttacctagcgacagtgccgtacggttcgggcccacgaggtccctacggaagggccgaggggtntagggagggttgggacgtacgtaggttttgttgggttaccgngttaaggtaactagtagaaactttagtnacggacgaggtacggtacggtaagggaccgtaccttatacccgacgtagttccaacggaagtaaccgtaacttaagtaccggaagtttacttaagttttnaacttcgtaagtcgaaatcgggaaccngggtcagggtacncggtacggagtacgtcgacgtttatacgggtacttcggaggtacgagttaagaaacggttacgagggagggttacgttaggttaccggtaagggngttacggggc

SEQ ID NO: 6168 - DNA, 765 bp, Homo sapiens
  misc_feature: GYAE6OF01CSIR9.24.76.G10.1.454.CMB.1.raw
tcagactactatgtcacgaccggtgctcgatttagtcactcatacgagggggggagaggagcccagcactagaagtcggcggtgttccattcggtgatcagcactgaacacgagaggactcaccagtggagtttggcctgaacgttgggttttccctcgttgcttacttttaaggaggtcgtacctagtgtcgaggtgacaggtctgggtaggtagtcgggtggggggagtcggtggtcccacggtccgttaggggacggttcccgtgacgtacgtcgtccgtgtcgcgtagcgtcgtagacacgtactctacctaactaccgtagaggtctagtcggacaccgttaccgggcccgaccgacggcctacggacggaccgacggggtgtagggaggtgggcgtacgttagtttagttggttagtagtacgtaaataagtagaattacgtagtgtacgaggtacgtacggtacgggtacggaccgtacgtactaccgtgtaccgaaccacgtacgaacctaacgtacggtaaggttagttaaccgtttagtaccgttacgtaacgtaacggtaacgtaagtaaccgtaccgtacggtaacggtacgggtaaccgtacgggaaccgtaaccggtaacggttacgttaacgttaggttacccgttaaggtcggttaacggtaacggtaaacggttacgggtaaaccggaacggttaagggaacgggttacgggttacgggtaacggggtcgggttaacggggtacccgg

SEQ ID NO: 6169 - DNA, 820 bp, Homo sapiens
  misc_feature: GYAE6OF01CS7VR.24.76.G10.1.454.CMB.1.raw
  modified_base (175)..(175): a, c, t, g, unknown or other
  misc_feature (175)..(175): n is a, c, g, or t
  modified_base (190)..(190): a, c, t, g, unknown or other
  misc_feature (190)..(190): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaaggaggtntccgagtgtcaggtncagtcgtgggtggagtcggtgggggagtcggtggtccagccgtggggacggtccctgagtctgtcctggtcgcgaggtcgttcgtaggaccactactcttacaaacgttaccctagtcggactagtacgccgtacggtccggggtcccgaccgacgggtcctccggaagggtaccggaaggggtctggggtacgggttggggtcgtacgtttagggttttaagttttcgggttaatacggttaacggtaaaacttaaggtaacggtaaatttacgtacggtacgtaaccgtacgggttaaccggttaccggggttaagggaaacccgggtaccgttaacttacccgtaaccgtacgttcccgtaaccgtaacggaaccgttaaaccgttaacgttaaccggtaaggttaacgtttaacgttttaacgtaactttacgttaacgaaagttaacgtaacggtaacgttaccggaaccgtagggtaaaccggtaggttaccggaaacggtaccgtacgttaacttaaggttaccgtttaaggttacgtaacggttcgtaacgttaaggtaaacgggaacgtagggtaaggtacgggttaggttaggggtaccgtaggggttaacgggtaccgg

SEQ ID NO: 6170 - DNA, 1022 bp, Homo sapiens
  misc_feature: GYAE6OF01EVKR3.24.76.G10.1.454.CMB.1.raw
  modified_base (361)..(361): a, c, t, g, unknown or other
  misc_feature (361)..(361): n is a, c, g, or t
tcagactactatgtcacgaccggtgctcgatttagtcactcatacgagggggggagaggagcccagcactagaagtcggcggtgtttccattcggtgatcagcactgaacacagaggactcaccagtggagtttggcctggaacgtttgggttttcctcgttgtctttcgttttaaggaggttgtcctagttgtacgaggtgcaggtcgtgggtggaggttcgggtggggggacggtcggttcgggtacccgacggccggttggggacggttccccgtaggacggtaccgttcgttcccgtggtcggccgtaggtccgtcgtacggacctaacctagttccttaacgaaacttcctaaggnggactagtccgacctacggtccggggtccccgaccgtacggccgtaccggacgggtaccgggaacggggtcggtgggtagggttggggtacgtcggttaaggttttaggttttagggttggtaagtaacggtaaattagttaacgtaagttaacgttagtagtacgaagggtaccggtaaccggtaacgggtaaccggtacccgttaacgttaccaccccgtttaaagtcccgtaaccgtaacggtaaacgttaaacccgttaaaccggttaacggtaaaccgggtttaatttttaaaccggttttttaacgttaacgtttacccccgtttaaggttaaaccggtaacggtaaccgggttttaaaacccgacccggggttaacttaacggggtaacgggtttaacccgggtaaaccgggggtaaaaccgggttccccggttaaaacggggttaacccttttaaggggtttaaaacccgtttttaggtttaacccggggttttacggttaagggtaaaaccggggtttaaacggtaaaaccgggggtaaaacgggttaaaaccgggggttagggggggtttaaacccgggtttaggggggtttttaacggggggtttaaaacccgggggtttaaggggggttccccgggtttaaaaccgggg

SEQ ID NO: 6171 - DNA, 588 bp, Homo sapiens
  misc_feature: GYAE6OF01B93BL.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccaggcctggggaggtccctgagactgtcctgtgcaggcgtctggacacattcctcaatcctatggcatgcactggggtccgccaggcctccagggcaagggggctgggagtgggtggctagtttagtttggtttgattagggaacttagtgaattactagtgactagacgtccgtggaacgggcctattacaccactctcgagtagactaactcgaaggagttaattttgtatcttacgagtatgaacgtcgcctggacgtacggtacggagggaccgacggtactagttcggttattaccgttggtacggcgtaagttcggaaaacggtgaagggtacgggtagttcggggttacggtggtcggggtacgg

SEQ ID NO: 6172 - DNA, 778 bp, Homo sapiens
  misc_feature: GYAE6OF01ANNE9.24.76.G10.1.454.CMB.1.raw
  modified_base (155)..(155): a, c, t, g, unknown or other
  misc_feature (155)..(155): n is a, c, g, or t
  modified_base (650)..(650): a, c, t, g, unknown or other
  misc_feature (650)..(650): n is a, c, g, or t
  modified_base (679)..(679): a, c, t, g, unknown or other
  misc_feature (679)..(679): n is a, c, g, or t
tcagactactatgtcacgaccggtgctcgatttagtcactcatacagggggggagaggagcccagcactagaagtcggcggtgtttacccattcggtgatcagcactgaacacagagactcaccagtggtagtttgcctgaacttgggttttccngttgcttactttaagaggtgtccagtgtcgaggtgccagcgtggtgagtcgtgggggacgcgtcggccaggccgttagggacggtccctggaacgtccgtgtccgtgtcgacgtagcgttacgtacgggaaccacggttattccgttacaaacgttacctagtcggactatcggaccgtaccggtcgggtcccgaaccggacgtcccgtaccggtaagggaccggtaacggggtcggttaggtaacgggttcggggagtaaccgtttaaggttttaggtttcggttaagaacggttacgaaaaacgttgtaaacggaactttacggtctacggaacgacgggttacgtaaccgggtaggtaaccgggtccttactaccgaccgtactcccgacgaagtaaccgtaaccgtacgttacggaaggttatttacccgtttagacgttaccggtaatacggaacttaacgaacgttaaccggtcgaagggtaacgggtntaacgggacgtaaccgggcttaaaccggngttaaaccggtcgttaacgtcgggttaagacccgtaaggttaccgaaacgggttccaaggggtcctttaaggtacgggtacgtagggtcccgggtaacg

SEQ ID NO: 6173 - DNA, 742 bp, Homo sapiens
  misc_feature: GYAE6OF01ARCXV.24.76.G10.1.454.CMB.1.raw
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
tcagactactatgtcacgaccggtgctcgatttagtcactcatacgagggggggagaggagcccagcactagaagtcggcggtgtttccattcggtgatcagcactgaacacagagactcaccatggagtttggcctgaacttgggtttttcctcgttgcttacgttttaagaggtgtccagtgtcgaggtgcagctggtggagtcgtgggggngtcgtggtccagccgtgggacgtccngacgactgtcctgtcgcagtccgtacgtggaccactacgttcttacaacgttacctagtcggactagtccgacgtccggttaccgggcccgtaccgaggtccctacccggagggtaccgggaacggggttcgtggggaacgggtttcggggtcgggtaccgtttaaggttttaggttttaccggtttaggtaacggtaagggtaaaaccttaaggttaaggtaaaacctaacgttaacgtaggaacgtaaacgggtacgggttacccggaagggaaacccgggtacccttaagttaccgaacctacgtacctaccggaaagtacgtaactaacggttaccgaaggttaagttaagtttcgttaactacgttacaggtaactacgtactagtaacgtgtaaggtacgtagaagacgtacgtacgttagtagtacttacggtgtacgtagaattaaggacgtagtaacgggtaggttacggttaggacgggtgtcggggtaacg

SEQ ID NO: 6174 - DNA, 886 bp, Homo sapiens
  misc_feature: GYAE6OF01AZK4P.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagcgtggtggagtcgtggggggagtcgtcggtccagccgtaggggcgttccctggacgtactcggtcctggtcgcctaggtccgtcgtacggaccacgtattcgttaccaaacttacctagttggcctagtcggacctacggttcggggtccccaccgtacgggtaccttacccggaaggggaccggtaaaggggggtcccgttaaggggacgggtttcgggggtacgggtaccgtttaaagggttttttggtttttcggggtttacggaaaggtttacggggtaaaaacctttaagtaggttaaactttaccggttaaagttccggaaccgtaaggttaccgggttacccggtaaggggtaacgggtaccccgttaatttacccgaccgttacttacccgtaaccgaaggtaacccgtaacttaacggtaccgtaaagggttaacttttaagttttacggtaaccttttccgaaacgtagtaaccgttaaccgaacgttaccgaccggtttaaggaacgggttaccgggaaacggttaccccggggtaacgtaacccgggttagttaaggtttaccgtttaaacgttaacggttggtaaaccggtacgggttaaaggttaacggaaaaccggggtacgggttaaagggggtacttaggggtttaacgggtttcgggaaaggggtttcccgggaaag

SEQ ID NO: 6175 - DNA, 913 bp, Homo sapiens
  misc_feature: GYAE6OF01DWVN7.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccagtggagtttggcctagaacttgggtttttcctcgttgtcttacttttaagaggttgtccagtgtcaggtgcagcgttggtggaggtcggtggggggacgcggtcggtccaggccgtaggggacggttcccctggactacgttcgtccgtggtcgcgacggtccgtacgtacggaacctacacttccttaccaaacttaccgtagtgacatcgaccgtcggtcgggtccccgcgacggtcctaccgaggggtaccggtaacggggtcgtaggggtcggggtcgggtacgggttacgttaagggtttttaaggtttttggggtttaacggtaacggtttaacgggtaaaaaccgtttaaaggttaaacggttaaacgtttaacggtttaagtacggggtaaccgtaaagggtaaaacccggtttcccgggtaaggggtaaaccgggtcccggttaactttaaccccgacctaaccgttacctaacccggtaaacggtaaaccggttaaccttaaaccgttaccgggttaaacggttaaccgggttttaaacgttttttacggttaacttttaaccccgttttaagaaacgggttaatttaaaccgggaactttaaccgggtaaccgtacgggtaacgggttaccggtaacgggaccgggtaaccgtacggttaacgttaagttacggttaccgtttaaggttccgttaggtaacccgaagttaaagggaaacggtacgggtaaggtaacgggttaacgggttaccggtagggtcggggttcggtaaccggg

SEQ ID NO: 6176 - DNA, 774 bp, Homo sapiens
  misc_feature: GYAE6OF01EZOHA.24.76.G10.1.454.CMB.1.raw
  modified_base (186)..(186): a, c, t, g, unknown or other
  misc_feature (186)..(186): n is a, c, g, or t
  modified_base (597)..(597): a, c, t, g, unknown or other
  misc_feature (597)..(597): n is a, c, g, or t
  modified_base (720)..(720): a, c, t, g, unknown or other
  misc_feature (720)..(720): n is a, c, g, or t
tcagactactatgtcacgaccggtgctcgatttagtcactcatacagggggggagaggagcccagcactagaagtcggcggtgtttccattcggtgatcagcactgaacacagaggactcacatggagtttggcctgaacttgggttttcctcgttgctcttttaagaggtgtccagtgtcaggtncaggctgggtggtaggtcggtgggggaggcggtcggtccagccgtggggacggtcccgtggacgtacgtcgtccgtggtcgcgtagccggttcgacggactacgtacttaccttaccaaacttacccgtagtcggactatcggacctacggtcgggtccccgccgacggtcctaccggaggaccggacggggtcgtggggtagggtgggggtcgtacgttaggttttcggttttgggttacgaggttaaggtaaacgttaagttagtaattacgtatacggtacgtagggtccggttacggtagggaaccgggtacccgtatttacccgaccgttactcccgtacggaagtaacgtaaccgttaacgttaccggaaaggttacttttaagtttcgtactttcttacggaanacgtacgaactacggtaccgtaggtacgtaaccgggtacgaaacggaccggtaacgttaccgttaagggttctttaaacggtacgttagggtaccgtaagggttaaggtaacgggtaaacggngggttaagggtaacgggttggtttaacgggggtacggttagggtacgggtacgg

SEQ ID NO: 6177 - DNA, 774 bp, Homo sapiens
  misc_feature: GYAE6OF01C2XS2.24.76.G10.1.454.CMB.1.raw
  modified_base (375)..(375): a, c, t, g, unknown or other
  misc_feature (375)..(375): n is a, c, g, or t
tcagactactatgtcacgaccggtgctcgatttagtcactcatacgagggggggagaggagcccagcactagaagtcggcgtgtttccattcggtgatcagcactgaacacagagactcaccagtggagtttgcctagacgttggttttccctgttgcttacttttaaggcggttcgtccgtagtgtacgaggtgcgagtcgttgggtggaggtcgggtagggggagtcggttcggccgacggtccggtcggggtaacgttccctaggaacgtcgttcgttccgtgtcgcacggtcgttcgacggacctactaacgttcttaactaacgtaccgtagtggactagtcgtccgtacggttccgggccccgtaccgnggtccgacggaacggtaccgggtacggggtgtaggggtacggtggggtacgttacgttaggttttgtttggttacgtaagtaacgttaaacgtttaaagtacggttaacttacgtagtacgtacgtagggttaacggtaccggttaaggtaacccggtacgttaccgttaaccgtaccgtaaccgttaccgaacgtaacgtacccgtaaacgtaacgttaaccggtaagtttaacgtttacttttaacgttacttacgttagtacgtaacgtaacgtactacgaacgtaggtaagacgtacgtacggacgtacgtagttacgttacgtagttagtcgtacggtataagggtacaacggtagtacggtacggttagttacgggtaggtcggttggtacgg

SEQ ID NO: 6178 - DNA, 775 bp, Homo sapiens
  misc_feature: GYAE6OF01D2EON.24.76.G10.1.454.CMB.1.raw
  modified_base (349)..(349): a, c, t, g, unknown or other
  misc_feature (349)..(349): n is a, c, g, or t
tcagactactatgtcacgaccggtgctcgatttagtcactcatacagggggggagaggacgcccagcactagaagtcggcggtgtttccattcggtgatcagcactgaacacagaggactcaccatggagtttggcctgaacttgggttttcctcgttgccttacgttttaagaggttgtccagtgtcaggtgcagctggtcgagtcggtggggaggcgtggtaccagcccgtggggacgtccccgtagacgtacgttcgtccgtggtcgacaggtccttacgtcggacaccttattccgttacaaactaccctatggcctattacggacctacgttcggggtaccccnccggtaacggcccttaccggagggtaccggaacgggggtctaggggtcgggttggggtacggtacgtttaaggtttgttttgggttagtagttaccggtaaagttaagagtaaattacgtagtcgacgacggtagtccggtaagggacggtacccttagtaccaccgtacgtccgtactaacggaaccttagtaaaccgttaccggaagggttaatttaacgttttacgtaacgttttaccctaagtaacgtaagtactaaaccgtacgttaccgggtaggtaaccggttaggtaccggtaacggaaccgtacgggttctaaaccgttttagtaaacggttttcgtaccggtcgggtaaggtaacggaaacgtacgggtacgaaggggttagtacgggtttggtaaccgggagggtggtaacccgg

SEQ ID NO: 6179 - DNA, 895 bp, Homo sapiens
  misc_feature: GYAE6OF01C5GC7.24.76.G10.1.454.CMB.1.raw
  modified_base (169)..(169): a, c, t, g, unknown or other
  misc_feature (169)..(169): n is a, c, g, or t
  modified_base (174)..(174): a, c, t, g, unknown or other
  misc_feature (174)..(174): n is a, c, g, or t
  modified_base (188)..(188): a, c, t, g, unknown or other
  misc_feature (188)..(188): n is a, c, g, or t
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggctgaacttgggttttcctcgttgcttctttaagnggttntccagtgtcaggtnacngtcgtggngaggtcggtgggggngtcgtcggtcgagtccgtgggaccgtcctaggactcgtcgtcctggtacgacacggtcgttaccgagacctacattctaacgtaataccttgtcggacctatcggaccgtcgttcccggggccgaccgtacggtcccgtaaccgaggggacggtaacggggcttaggggtacggttcgggggataccggttttaaggtttaacggttttcgggtttagaaacggtttacggtaaaaaccgttaggttaacggttaaacttaaccttagggttaggaaaccgttaacgggttaccggggttaaaccggtaaagggtaaacccggggtttaccctaaccgtttaccgaaaccccgttaacgtttacccgaaacccggtaacgttaacgtaaaacccgtaagtttaacccgggtaaggttaaaccgggtttaatttttaccggaacgttttaccttaaccgggtaagttaaccttaacgggtaaaccgtaaccggggttccttaacgggaaacgggtttccggaaaccgggttaaaggtaccccgggtaacggttaacttaacgggttaaccgtttagttaaccggttgggttacccggtaagggttaacgttaacgggaaacggtacggtaaaggggtacggttacggttacggggtttaacggtaagggtcgggttaaccgg

SEQ ID NO: 6180 - DNA, 657 bp, Homo sapiens
  misc_feature: GYAE6OF01A260O.24.76.G10.1.454.CMB.1.raw
  modified_base (567)..(567): a, c, t, g, unknown or other
  misc_feature (567)..(567): n is a, c, g, or t
  modified_base (574)..(574): a, c, t, g, unknown or other
  misc_feature (574)..(574): n is a, c, g, or t
  modified_base (627)..(627): a, c, t, g, unknown or other
  misc_feature (627)..(627): n is a, c, g, or t
tcagactactatgtcacgaccggtgctcgatttagtcactcatacagggggggagaggagcccagcactagaagtcggcggtgttccattcggtgatcagcactgaacacagacggactcaccatggtagtttgcctagaacttgggttttcctcgttgcttacttttaaggaggttgtcctagtgtcgaggtgcgtagcgtgggtggaggtcgtgggggagtcgtcgtccgagccgtggggacgtcctagagtactcgtcctggtcgacgaggtccgtcgacggtaccacgtattccgttaacaaacgttacccttaagtcggaccaagtcggacctacggtcgggtaccccgaccgacgggtccctacccggaggccggtaaagggggtccgtgggagggtgggtcggacgttaagtttagttgggtacgtaagtaggtaaactagtagtaactcgtagtaggacgtaggacgttcggtagggaacgtcgtactccgaactacgtctacgaagtactaactacgtacgaaggtagttaacttgtaactcgtacgagtactagacncgtacgngagtcgagacgacgtagtcgtagtactcgtaacgtgtacgagtactaggacgngtagggactaggttagacggtgtgggtacg

SEQ ID NO: 6181 - DNA, 769 bp, Homo sapiens
  misc_feature: GYAE6OF01A6BNE.24.76.G10.1.454.CMB.1.raw
  modified_base (151)..(151): a, c, t, g, unknown or other
  misc_feature (151)..(151): n is a, c, g, or t
  modified_base (169)..(169): a, c, t, g, unknown or other
  misc_feature (169)..(169): n is a, c, g, or t
  modified_base (387)..(387): a, c, t, g, unknown or other
  misc_feature (387)..(387): n is a, c, g, or t
tcagactactatgtcacgaccggtgctcgatttagtcactcatacagggggggagaggagcccagcactagaagtcggcggtgtttccattcggtgatcagcactgaacacagaggactcaccatggatttggcctgaactgggttttccncgttgcttcttttaaggnggtgtccagtgtcaggtgcaggtctgggtggagttcgtggggggaggcggttggtccaggcccgtggggacggtcccctaggacgctcggtcccgtaggtcgacgagtcgtcctgggacaccgtattccttacaaacttcctaagtcgacatcgtcgtaacgtcgggtacccgcctagggccctccgagggcgtaaggggccttgggagggttggggngtacgttaggttttagtttgggtttagagttaggtaactaaagtacgaacttagtactggagtacgtagggtaccggtaggaacgtccgtaacgttaccgaccctaatcccgtaccgtaacgggaaccgtaaccgtaacgttaaccgtaacgggtaacgttaaacggtttttgaaacttttacgttacgaaaggttaccgtaacgtaaaccggcgtacccggtaggtaaccgggtagttaccgggaacggttacggtaccggtcgttacgttaacggtttaacgttacggtacggttgttaccgaaggttaacggaaacggttacggaaaccgggttagggtaacggtttccggggtaaacggttgggtaaggggtacccgg

SEQ ID NO: 6182 - DNA, 776 bp, Homo sapiens
  misc_feature: GYAE6OF01BV0GV.24.76.G10.1.454.CMB.1.raw
  modified_base (176)..(176): a, c, t, g, unknown or other
  misc_feature (176)..(176): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaacgttgggttttcctcgttgcttcttttaagaggtntccagtgtcaggtgcagctgggtggagtcgtggggagcgtggtccagccgtgggacgtcccgtgagtacgtcgtccgttgtgccaggtccgttcgtacggaacctaccgtatttccttacaaacttacccgtagtcggactaagtcgcctaaccggtcgggtaccccgaccgaggtcccgtacccggagggaccggaaggggtccgtaggggtacgggtcgggtacggtaccgttaggttttagttttgggtttagaagttaggaaacttacgtagaacttagtagttcgactaggtacgtccggtaggaaacggtccgtattaccgacctactccgtaccgaaggtacgaaaccttaacgtaccgaagggttaatttaacgttttacgtagtttaccttaacgaagttacgttaacgaacgtgtacccgttaaggaaccggttacgtacggaaaccggtacccgtacgtaccgtttaaggtacgtttaacgttaaccggttcggtaacggtaccgggtaagttaacgggaaaacggtcccgggttaaagggaccgggtttaggtttagggggtacgttaagggggtcgggttaacccgg

SEQ ID NO: 6183 - DNA, 742 bp, Homo sapiens
  misc_feature: GYAE6OF01A10KN.24.76.G10.1.454.CMB.1.raw
  modified_base (398)..(398): a, c, t, g, unknown or other
  misc_feature (398)..(398): n is a, c, g, or t
  modified_base (697)..(697): a, c, t, g, unknown or other
  misc_feature (697)..(697): n is a, c, g, or t
tcagactactatgtcacgaccggtgctcgatttagtcactcatacgagggggggaggaggagcccagcactagaagtcggcggtgtttccattcggtgatcagcactgaacacagaggactcaccatggagtttggcctgaacttgggtttcctgttcgctcttttaagaggtgtccagtgtcaggttgccagctgggtgacgtctgggggagcgtggtccagccgtggggaggtccctggagacctcgtccctggacgcagccgtctggacacacttcttaccaataccctagtcgggccaacgtcgaccacgtcggggtacctaccgaggtcctcaagggccttaaagggggctagggacggtggggtcggacgtaggttttactttacgggtttnaacggtttggaaaccgttaagttggtaaaacttagttacgtcggtacacgtaacggttcccggttaaggaaccgggttcccgtattacccgtaccgtaacggttcccaaccccgttaaggaaccggtaaccgttaaacgttcccggtaaaggtacgttaaacggttttttacgtaacttacccttttaaggaacaagttaagtaacccgagtacccgtaggtacggtacgtaacggacggtacgaacgtcgaacgttacgttacgttaccggtagttcggtacgaggtacggaaaccgnggtaacgggtaacgtcggttaggttaccgggtggttcgggtaacg

SEQ ID NO: 6184 - DNA, 956 bp, Homo sapiens
  misc_feature: GYAE6OF01D0W2P.24.76.G10.1.454.CMB.1.raw
  modified_base (340)..(340): a, c, t, g, unknown or other
  misc_feature (340)..(340): n is a, c, g, or t
tcagactactatgtcacgaccggtgctcgatttagtcactcatacagggggggagaggagcccagcactagaagtcggcggtgtttccattcggtgatcagcactgaacacagaggacctcaccatggagtttggcctgaacttgggttttcctcggttgtcttacgttttaaggaggtgtccagttgtcaggtgacagcgtgggtggagtcggtgggggagcggtggccacgccgtgggacgtccgtgagtacgtcgtccgtggtcgcgacggtcgtcgtacggaccactacgttcttaccaaacttaccctagtgcatcgcgtaccggtcgggtcccnccggaggtcccgtaccggaggggaccggaaagggggtccgtaggggtacggggttggggtcgggtacgtttaagggttttacggtttttaggggtttaacggtaacggtttaacgggtaaaaacgttaaacgttaacgggttaaatttaaacccggttaaagttcggtaccggtaaacgggtacggtttacccgggggtaagggttaaacccggggtaccgttaaccgtttacccgaaccctttaaccgttccttaaccgggaaaacgggttaaacaaaccggttaaaaccgtttacccgggtaaaaggggttaaacgtttttaaacgttttttaacgggttaacctttacgtttaacccggtaaggtaaaccggtttaacggaaaaccgttcccggaaccggtttacgggaaacggttaaccgggttaaaccggggtaacgggaacccggttaaccgggttaaccgtttagttaacgggtttaaaccgtttaacggttcggtaacgggtaccggtaaacggttaaacggaaacccggggtagggttaaaccgggggtaagggttaaacgggtttacggggttaccgggggtaacggggttaaggggttaacccgg

SEQ ID NO: 6185 - DNA, 922 bp, Homo sapiens
  misc_feature: GYAE6OF01BZ7ML.24.76.G10.1.454.CMB.1.raw
tcagactactatgtcacgaccggtgctcgatttagtcactcatacgagggggggagaggagcccagcactagaagtcggcggtgtttccattcggtgatcagcactgaacacagaggactcaccatggtagtttggcctgtaacgttgggtttttcctcgttgtcctttacgttttaaggaggttgtccaagttgtcgtaggtgacaggtcgttaggtggaggttccgggtaggggggtggtccggttcggggtacccgaggtcccggttagggggtaaccggttcccccgtaggtaacgtaccgtttccgtcccgttggtcgaccggtacgtccggttccaagggtactaaccgtacttaccttaactaaacgttaccgtaggtacgacgtacgtcggtaccgtaccggtacgggtacccgaccgtaccgggtacccgtaaccggaacgggaccgggtaaacgggggtcggttacggggtaacgggttgggggtaaccggtttacggttaaagggttttttaggtttttagggtttaaggtaacggtttaacgggtaaaactttaaaagggttaaacgttaaaacgtttaacgtacgttaacgaacgtaggttaacccggtaacggtacgggtaaacggttccggtaacttaacccgaccttaccgtaccgtaacgtaaacgacgtaaaccgttacgttaaaccggtaagtaacgtttaacgttttacgtaaccgtttacgttaaccgtaacgtacgtaacgtacgtacggtacgtaacggacggttacgtacgggtaacgtacgtacggtaacgttacggttacgtttaccggtacgttaggtacggttaacgtaaggtaacgtacgtaaggttaacggttaggtagggtttaaggttacgggtagggtacggttacggg

SEQ ID NO: 6186 - DNA, 872 bp, Homo sapiens
  misc_feature: GYAE6OF01DRP13.24.76.G10.1.454.CMB.1.raw
  modified_base (158)..(158): a, c, t, g, unknown or other
  misc_feature (158)..(158): n is a, c, g, or t
  modified_base (166)..(166): a, c, t, g, unknown or other
  misc_feature (166)..(166): n is a, c, g, or t
  modified_base (175)..(175): a, c, t, g, unknown or other
  misc_feature (175)..(175): n is a, c, g, or t
  modified_base (195)..(195): a, c, t, g, unknown or other
  misc_feature (195)..(195): n is a, c, g, or t
  modified_base (306)..(306): a, c, t, g, unknown or other
  misc_feature (306)..(306): n is a, c, g, or t
tcagactactatgtcacgaccggtgctcgatttagtcactcatacgaggggggggagaggagcccagcactagaagtcggcggtgtttccattcggtgatcagcactgaacacagaggactcaccatggagtttcggcctagacttgggtttttcccngttgcttnttttaaggnggttgtaccagtgtcaggtncagctgggtagcgtcgtgggggagcgtaggtcctagccgtagggggacgttccctaggagactgacctggtgctagcgttcaggacactaatcgttacaactaccgttaancgggaactacgtcgaccgtccggttacgggggtacccaccggtaaagggtcccttaccggaacgggtaaccggaacgggggtccggttagggggaaggttgggggttacgaccgtttaaagggtttaggttttgggttacgaacggttaaggttaaaccgtaaaagttggaaaactttacgttaaagtcgggttaacgtacgggaaaccggttttcccgggaaaaggtaaccggggggtaacccctttaacgttaacccggtaaccctaaccggtttaacccaaccccggttaaaggaaacggtaaccgttaaacggttaaaccgtaagggtttaagttaaccgttttaaggttaccgtttaccttaaccgtaaggtaacgttagaaaccgtaacgtacccgtaaggtaacggacggttaccgggaacggtaaccgtacgggtaaccgttaagttaacggttacttacggttacggttcggtaaacggttcggtaaaaggaaaccggttacgggaacggtaagggttaacgggtagggttaaacgggtcgggtagggggtaacccg

SEQ ID NO: 6187 - DNA, 708 bp, Homo sapiens
  misc_feature: GYAE6OF01AMW7Y.24.76.G10.1.454.CMB.1.raw
  modified_base (154)..(154): a, c, t, g, unknown or other
  misc_feature (154)..(154): n is a, c, g, or t
  modified_base (698)..(698): a, c, t, g, unknown or other
  misc_feature (698)..(698): n is a, c, g, or t
tcagactactatgtcacgaccggtgctcgatttagtcactcatacgagggggggagaggagcccagcactagaagtcggcggtgtttccattcggtgatcagcactgaacgacagaggactcaccatgggatttggcctgaactgggttttccncgttgctcttttaagaggtgtccagtgtcaggtgcagctggtggagtctgggggagcgtggtccaggcctggggacgtccctagagactggtcctgtcgcaggcctctaggaccacgattcgttcaacgtacctatcgggcagtcgcgtaactcgggtaccgccaggtcctccgaggcgaagggggtctgggagtggggtgtacgtaggtttactttgggtttcgaagttgggaaacttagtagtaaacttacgtaatggacacggtagtccggtaggaaacggggtccctaagtttccaaccgactttccgaccgacggaacgaaccgtaacttacccgaaagggtaaccgtttaacgtttttaacggtactttaccgttaccgaagttacttacggaacgtacggtaaccctaggaacgttacggtaccggaagggttaaccgaccggttacgtacgtttgtaaaccgtttacgtacgggttacgtacggaaatacgggaaaaggtcgtaaacgggaacgggttataggggttcgtaagggnggggttaccg

SEQ ID NO: 6188 - DNA, 835 bp, Homo sapiens
  misc_feature: GYAE6OF01AKO3Q.24.76.G10.1.454.CMB.1.raw
  modified_base (310)..(310): a, c, t, g, unknown or other
  misc_feature (310)..(310): n is a, c, g, or t
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
  modified_base (633)..(633): a, c, t, g, unknown or other
  misc_feature (633)..(633): n is a, c, g, or t
  modified_base (643)..(643): a, c, t, g, unknown or other
  misc_feature (643)..(643): n is a, c, g, or t
  modified_base (798)..(798): a, c, t, g, unknown or other
  misc_feature (798)..(798): n is a, c, g, or t
  modified_base (823)..(823): a, c, t, g, unknown or other
  misc_feature (823)..(823): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaacgttgggttttcctcgttgccttacgttttaagagggtcgtaccaggttgtcgaggtcgcaaggtcgtgggtggaggttcgggtaggggggcggtcgtcggtaccgacggccggttgggggtacgggttcccctagggacgtaccggttcggttaccgttggtaccggnggtacgtccggttacgtacgggaacctacacttacctttacaaaacgttacccgttagtcggacctagttacgcccgtcggtccggggtccgaccgnggtcccgaccgagggacggtacggggngtacgggtagggttcgggtaggacgttaggtttaggttgggttaccgtaagtaggtaaactaagttagtaaactcgtaagtgaaccggtagtacccgggttacggttacggaccgggtccgttaactacctaccgtacgtaccgtacccgtaaggaacctaacgtaacgtacgtaaaggttagtttacgttttacgttntttaaccgtnttaacggataaccgggtactacgtaccggtaaggtacggtacggtaaccggtaccgggaacgtacgggtaccgttaagttaaccggttaggttttaacggcgggttaacggaaccgtaagggtagaaaaccgggtagggtaacgggttaacgggnttaaggggttcggggttaaccgggngggttaccccgg

SEQ ID NO: 6189 - DNA, 740 bp, Homo sapiens
  misc_feature: GYAE6OF01BLN2K.24.76.G10.1.454.CMB.1.raw
  modified_base (220)..(220): a, c, t, g, unknown or other
  misc_feature (220)..(220): n is a, c, g, or t
tcagactactatgtcacgaccggtgctcgatttagtcactcatacagggggggagaggagcccagcactagaagtcggcggtgtttccattcggtgatcagcactgaacacagaggacctcaccatggagtttcggcctgaacgttgggttttcctcggttgccttcttttaagaggttgtccagtgtcaggtcgcagcgtggtcggagtcggtgggggngcgtcggccagccgtgggacgtccctgacgacgtgtccgtgtacgcagcgtcgtagaccactacttacttacaacttaccgtatcggactagtcgaccgtacgtcgggcccaccgcgtccgtaccggaggacggacgggcgtagggtaggtgggtagtacgtttaggttttagtttcggttagacgtaggtaaacttagtagtaacttacgtagtcggaacgtaggtacgttcggtaagggaaccggtaccgttacttacccaaccgttacgttacccaacggaaagtacgtaaaccgtttacgtaccggtaaaggtaacggttttaacttttcgtaaacctttcgttaacgtaaggtaacgttaacgaacgtccgtaacggtaggaacggttaaccggtacggaaccgggttactaccgggttaatttacggtaggtttaaaccttcggtaggttaggacgtaaaggtcgggaaaccgtggaaaggttcggtaagttcgggtaggtacgggtggtaccg

SEQ ID NO: 6190 - DNA, 1035 bp, Homo sapiens
  misc_feature: GYAE6OF01C9VN7.24.76.G10.1.454.CMB.1.raw
tcagactactatgtcacgaccggtgctcgatttagtcactcatacgagggggggagaggagcccagcactagaagtcggcggtgtttccattcggtgatcagcactgaacaccagacggactcaccagtggagtttcggcctggtaacgttcgggttttccctcgtttgctttacgttttaaggaggtgtaccgagtgtcgaggtgcgagcgtgggtggagttcggtgggggacggtcggtcggtcccgaggtccccggtggggtaccggttccctaggaacgtccgttcggtcccgttggtcgcgaggtccgtacgtaggaaccacgtacgtttaccttactaaacgttacccgttagttacggaccaagttccggtaccgtaccgggtccggggtaaccccggtccccgtagggtccccgttaaccgggcgggtaaccgggaacgggggtcgtacggggtaacggggttgggtgggtaccgttaaacgggtttttaggttttgggttttaacggacgtttaaacggggttaaaaccttaaaaggtttaacgtaaaccgttttaaccggttaacgtacgggtacggttaacggggttaaaccggggtttcccggtaaagggttaaccccggggaaccccggttttacttaacccggtaacccctaaccggtttaaccgaaccccgtaaaaggtaacccgtaaaccgtttaaacgtttaacccggggtaaacggtttaacgttttaaacgggtttttacttaaaccgttccggtttaaacctaagggtttaaccgtaaaccggttacggaacggttaccggttaaaccggtaaggggtaccgtttaaaggggaaccgttaaccgggttaccggtaaccgtttttagtaaaaccgggtttaccgtttaacgggtcggtaaacggttaacgggttaaacggttaaacgaaaaccggggtagttaaacggggggtaaaaccgtttggggtttaaacccggggttaccggggtaagggggtttaaacggttcccggggg

SEQ ID NO: 6191 - DNA, 505 bp, Homo sapiens
  misc_feature: GYAE6OF02IFST8.24.76.G10.1.454.CMB.1.raw
  modified_base (470)..(470): a, c, t, g, unknown or other
  misc_feature (470)..(470): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactgggtcccgccaggctccgaggcaaggggctggagtgggtggcagttatttggttgatggaactaatgaatactatgcatagtccgtgaagggccatcaccatctccagagacattccaggataattttgtatctttcagtatgaacacgctagagagtcgaggacaggctatgtattactgtgngatagaagcgaggaggagtggtcgaggtgggtacg

SEQ ID NO: 6192 - DNA, 517 bp, Homo sapiens
  misc_feature: GYAE6OF02GZ6W2.24.76.G10.1.454.CMB.1.raw
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactgggtccnccaggctccaggcaaggggctgggagtggggtgcagttattggttgatggaactatgaatctangcagagtccgtgaacgggccatcaccatctcagagacaattccaaggagtaatttgtattcttcagtatgaacagacctgagagtcgaggacacggctatgtattacgtgtgacgataggaagcgaagggacggtagttgggtacggaggtgggtaacgg

SEQ ID NO: 6193 - DNA, 502 bp, Homo sapiens
  misc_feature: GYAE6OF02IDSVY.24.76.G10.1.454.CMB.1.raw
  modified_base (323)..(323): a, c, t, g, unknown or other
  misc_feature (323)..(323): n is a, c, g, or t
  modified_base (363)..(363): a, c, t, g, unknown or other
  misc_feature (363)..(363): n is a, c, g, or t
  modified_base (430)..(430): a, c, t, g, unknown or other
  misc_feature (430)..(430): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactggtcccgccaggctccaggcaaggggctggagtgggngcagttatttggttgatggaactaatgaatactatgcagngtccgtgaagggccgattcacatctcagagacaattccaggtagaattttgtatcttcagatgaacngacctgagagtcgaggacacggctagtgtattactgtgcgatgaaagcgaggagagtggttcgaggtgggag

SEQ ID NO: 6194 - DNA, 527 bp, Homo sapiens
  misc_feature: GYAE6OF02I02XR.24.76.G10.1.454.CMB.1.raw
  modified_base (333)..(333): a, c, t, g, unknown or other
  misc_feature (333)..(333): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctctttaagaggtgtccagtgtcaggtgcagctggtggagtctgggggaggcgtggtccagcctgggaggtccctgagactgtcctgtgcagcgtctggacacatcttcaatacctatggcatgcactgggtccgccaggctccgaggcaaggggctgggagtggggtgcagttnttggttgatggaactaatgaatactatgcagtagtccggtagaacgggccctattccaccatctccagacgacaattccaggataattttgtatctttcagtatagaacagcctgagagtcggagacgacggtctagtgtattacgtgtgcgtagtagaagcgagggaggtagtgggttacggaggtgggtacg

SEQ ID NO: 6195 - DNA, 552 bp, Homo sapiens
  misc_feature: GYAE6OF02GW7FX.24.76.G10.1.454.CMB.1.raw
  modified_base (403)..(403): a, c, t, g, unknown or other
  misc_feature (403)..(403): n is a, c, g, or t
  modified_base (516)..(516): a, c, t, g, unknown or other
  misc_feature (516)..(516): n is a, c, g, or t
tcagactactatgtcacgaccggtgctcgatttagtcactcatacgaggggggagaggagcccagcactagaagtcggcggtgtttccattcggtgatcagcactgaacacagaggactcaccatggagtttggcctgaactgggtttcctcgttgctcttttaagaggtgtccagtgtcaggtgcagctggtggagtctgggggagcgtggtccagcctgggaggtccctggagactgtcctgtgcaggcgtctggacacatcttcaatacctatggcatgcactcgggtaccgccaggctccgaggccaaggggctgggagtggggtggctaggtttatttgggttgattgggaactaagtgaattactatgacagagtccgagaagggcattcacatccncagagacaagttccaggagtaattttgtattcttgagtatgaacagcctagagagttcggaggtaccgacggtactagtgtacttacgtggtcgtacgtaagtacggaaacgngaagggacggtacgttgggttacgtaggtgggtacg

SEQ ID NO: 6196 - DNA, 518 bp, Homo sapiens
  misc_feature: GYAE6OF02I0DUT.24.76.G10.1.454.CMB.1.raw
  modified_base (434)..(434): a, c, t, g, unknown or other
  misc_feature (434)..(434): n is a, c, g, or t
  modified_base (487)..(487): a, c, t, g, unknown or other
  misc_feature (487)..(487): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctctttaagaggtgtccagtgtcaggtgcagctggtggagtctgggggaggcgtggtccagcctgggaggtccctgagactgtcctgtgcagcgtctggacacatcttcaatacctatggcatgcactgggtccgccaggctccgaggcaagggggctgggagtggggtggcagttatttggttgatggaactaatgaatactatgcagagtccgtgaacgggcattcaccatctccagagacaattccaggataatttgtatcttcagtatgaacngcctgagagtcgaggacacggactagtgtattactggtgacgtagtagaaagngaagggaggtagtgggttcgaggtgggtacg

SEQ ID NO: 6197 - DNA, 664 bp, Homo sapiens
  misc_feature: GYAE6OF02H65BX.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactgggtcccgccaggcctccaggcaaggggctgggagtggggtggctaggtttagtttgggtttgagttgggaaacttaagtagtaaattactaatggactaaggacgttccggtaggaaacggggtcccgtaatttccgaacctacttcctacccgaaggtaacgaactaacgttcccgaaggtaagttaaacgtttttgtaattcctttacagtaagtacgaaactacgtaccgtaggacgtaaggtcggaacgggtaccgaacgggtacttaagttacgttacgtttaccgttaggtcggtaccgtaagtacgggaaaacgtccggaaggggtaaggtaggtttacggggtttacggtaggggttaggggtaacggg

SEQ ID NO: 6198 - DNA, 528 bp, Homo sapiens
  misc_feature: GYAE6OF02HKDTU.24.76.G10.1.454.CMB.1.raw
  modified_base (293)..(293): a, c, t, g, unknown or other
  misc_feature (293)..(293): n is a, c, g, or t
  modified_base (487)..(487): a, c, t, g, unknown or other
  misc_feature (487)..(487): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactgggtccnccaggctccaggcaaggggctgggagtggggtggctagttatttggttgatggaactatgaatactatgcagagtccgtagaacgggccgattcaccatctccagagactaacttccgaaggtagtaattttgtacttctttacagtatgaacagtcctagagagtcgaggacaggactagtgtacttacgtgngcgtatagaagcgagggaggagttgggtcgaggtgggtacg

SEQ ID NO: 6199 - DNA, 515 bp, Homo sapiens
  misc_feature: GYAE6OF02IEKGU.24.76.G10.1.454.CMB.1.raw
  modified_base (373)..(373): a, c, t, g, unknown or other
  misc_feature (373)..(373): n is a, c, g, or t
  modified_base (507)..(507): a, c, t, g, unknown or other
  misc_feature (507)..(507): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggaggtccctgagactgtcctgtgcagcgtctggacacatcttcaatacctatggcatgcactgggtcccgccaggcctccgaggccaaggggctggagtgggtgctagttatttgggttgatgggaactaagtagaatactatgcagngtccgtgaagggccattcacatctcagagacaattccaggagtaatttgtatcttcagtatagaacagtctagagagtcgaggacaggctatagtattacgtgtagcgatagaagcgaggaggagtgggtacgngtggtagg

SEQ ID NO: 6200 - DNA, 629 bp, Homo sapiens
  misc_feature: GYAE6OF02HHW8F.24.76.G10.1.454.CMB.1.raw
  modified_base (296)..(296): a, c, t, g, unknown or other
  misc_feature (296)..(296): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggagcgtggtccagcctgggaggtccctgagactgtcctgtgcagcgtctggacacatcttcaatacctatggcatgcacgtcgggtcccnccaggcctccgaggccgaaggggctgggagtggggtgctaggtttatttggttgattggaacttaagtgaattactagtgacaggacgtccggtaggaacgggccgtaattccaaccctatccgtaccaaggacgaactaaacgttccgaagggtaagttaaactttttgtaacttctttacagtatacggaaacacggtcctaggaagacggttacggaaggaccgacggtacgttaagtacggttatttaccgttaggttacggacgtaagtaaggaaaacgcggtaagggtaaggtacgttaggggtttacggaggggttagggtaacgg

SEQ ID NO: 6201 - DNA, 545 bp, Homo sapiens
  misc_feature: GYAE6OF02HJ956.24.76.G10.1.454.CMB.1.raw
tcagactactatgtcacgaccggtgctcgatttagtcactcatacaggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcacgtgggtcccgccaggcctccgaggcaaggggctgggagtgggtgctagttatttggttgatggaaactaagtgaatactatgctagagtccggtgaacgggcctattccaccgtatcctccagagacaacttccaaggtaataattttgattccttcaagtatagaaacagacctagaagtgtacggaagtaccacggtctaagtgtattacgtggtgcgagtagaagcgagggagtagttgggtacggtaggtgggtacg

SEQ ID NO: 6202 - DNA, 741 bp, Homo sapiens
  misc_feature: GYAE6OF02H2P1C.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggagtccctgagactgtcctgtgcagcgtctggacacatcttcaataccatggcatgcacgtgggtcccgcaggctccgaggcaaggggctgggaggtggggtggctaggtttagtttgggtttgagtgggtaacttaagtgtaaattactagtcgctaaggtacgttcccggtaggaacggggtccccgtaatttccgaacctacttccctacccgaaggtaaacgtaacaaacgtttcccgaaagggttaacgttaaagtttttaggttaacttacgttttaccgaagtaattacggtaaaccgtaacggtacccgttaagggaacggtaacggttacccgggaaaggggtaacccgtaaaccgggtaccgttaaacgtttacgggttaacgttttaccggtttacgggttaggtaacccgggttaagttaacgggaaaacggtaccgggtaagggggttaacgggtaaggttttacgggggtttaaccggtagggggtttacggggtaaccggg

SEQ ID NO: 6203 - DNA, 529 bp, Homo sapiens
  misc_feature: GYAE6OF02H1XJ7.24.76.G10.1.454.CMB.1.raw
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (400)..(400): a, c, t, g, unknown or other
  misc_feature (400)..(400): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactgggtcccgcaggcctccgaggcaaggggctggngtgggngctagttagtttggtttnatgggaacttaatgaatactatgcagagtccgtgaagggccgattcacatctcaganacaatccaggtataattttgattcttcagtatgaacagtcctagacgagttacggagaccgaggcctagtgtattacgtgtgtacgtagtagaaagcgaaggtacggagttgggtacgaggtgggtacg

SEQ ID NO: 6204 - DNA, 507 bp, Homo sapiens
  misc_feature: GYAE6OF02IMRVU.24.76.G10.1.454.CMB.1.raw
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactgggtccgccagggctccaggcaagggggctggagtggggtgcagttatttggttgatggaactaatgaatactatgcagagtccgtgaagggccattcgacccatctccagagacaattcaagganaattttgtatcttcagatganagcctgagagtcgaggacacggctatgttattactggtgcgatgaaagcgaggaggatgggtcgaggtgggacg

SEQ ID NO: 6205 - DNA, 592 bp, Homo sapiens
  misc_feature: GYAE6OF02I9AJY.24.76.G10.1.454.CMB.1.raw
  modified_base (292)..(292): a, c, t, g, unknown or other
  misc_feature (292)..(292): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggagcgtggtccagcctgggagtccctgagactgtcctgtgcagcgtctggacacatcttcaatacctatggcatgcacgtgggtccnccaggctccaggcaaggggctgggagtgggtggctagttagtttggttgagtggaactaatgaaattactagtgacagacgttccgaggaacgggcctattaccacctatcctaccgagacgacaacttccgaagggtacgtaagttttgtacttctttacgaagtatagaaactacgtacctaggaacgtaggtaccggaagggtaccacgggtacttaagttacgttatttacgtggtcggtaccgtaagtacgaaacggcgaagggtaggtagttgggttacggtagggttgggacg

SEQ ID NO: 6206 - DNA, 545 bp, Homo sapiens
  misc_feature: GYAE6OF02G1U4I.24.76.G10.1.454.CMB.1.raw
  modified_base (295)..(295): a, c, t, g, unknown or other
  misc_feature (295)..(295): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcacgtgggtcccnccgaggctccgaggcaaggggctgggagtgggtgcagttatttggttgatggaactaatgaaatactatgacagtagtccgtaggacgggcctattcacctatcctccgagagaactaattaccgaaggtagtaattttgtacttcttacagtatgaacagtacctagagagtcgaagacgacgctagttcgtattacgtgtgacgtagtaggaagcgaggtaggtagttgggttacgagggtggtacgg

SEQ ID NO: 6207 - DNA, 626 bp, Homo sapiens
  misc_feature: GYAE6OF02H0KWY.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtctgggggaggcgtggtccagccgtgggagtccctggagactgtcctgtgcagcgtctggacacatcttcaatacctatggcatgcacgtgggtcccgccgaggctccgaggcgaaggggctgggagtcggggtgctaggttatttggttgagtggtaaactaagtgaaattactatgcgagacggttccgtaggaacgggccgtattccgaacctactcctaccaaggtacgaactaacgttaccgaaggtacgttaaattttggtattccttacgtaagtacgtaagaaacctacggaccttaggaacgtacggtacggaacgggtaaccgacggtacttaagttgttacttacgttggtgtaccggtaagtacggtaaagacggtaggtacgggtagttgggtttacggagggttggggtaacg

SEQ ID NO: 6208 - DNA, 853 bp, Homo sapiens
  misc_feature: GYAE6OF02HEKP5.24.76.G10.1.454.CMB.1.raw
  modified_base (154)..(154): a, c, t, g, unknown or other
  misc_feature (154)..(154): n is a, c, g, or t
tcagactactatgtcacgaccggtgctcgatttagtcactcatacgaggggggggagaggagcccagcactagaagtcggcggtgtttccattcggtgatcagcactgaacacagaggactcaccatggagtttggcctgaactgggttttccncgttgctctttaagaggtgtccagtgtcaggtgcagcgtggtggagtcgtgggggacggcgtggtcccaggcccgtggggacggttcccctggaacgaccgttggttcccgtggtcgccgtacggtccgttcgtacgggaacctactattccttaccaaaacttaccccttaagtcggacctaagttccggacctaaccggttcggggtaccccaccgtaaggggtcccttacccggaacggggaccggaaacgggggggtccgtacggggtaacgggtttcggggggtacgggtaccgtttaagggtttttacgttttttcggggtttagaaacggtttacggggaaaaccttttaaagttacggtaaaatttaaccgtacggttacggacctaaggggtaaccgtttcccgggtaagggaaacggggtcccgttaacgtttacccgaaccgtacgttccgtacccgaaggtaacgtacctaaacgttccgaagggtaatttaacgttttcgtacttcttacgaagtacttacggaacgtacgtacccgtagggtaagtacggttaaccgacggtaaaccgtcggtaaccttagtacgtttacgtttacgtacgggtacggtacggtaagtaacggaaacggtccggtaaagggtacgggttacgttacggggtaccgggtagggttcggggtaaccg

SEQ ID NO: 6209 - DNA, 513 bp, Homo sapiens
  misc_feature: GYAE6OF02F7B97.24.76.G10.1.454.CMB.1.raw
  modified_base (293)..(293): a, c, t, g, unknown or other
  misc_feature (293)..(293): n is a, c, g, or t
  modified_base (368)..(368): a, c, t, g, unknown or other
  misc_feature (368)..(368): n is a, c, g, or t
  modified_base (419)..(419): a, c, t, g, unknown or other
  misc_feature (419)..(419): n is a, c, g, or t
  modified_base (491)..(491): a, c, t, g, unknown or other
  misc_feature (491)..(491): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggagcgtggtccagcctgggagtccctgagactgtcctgtgcagcgtctggacacatcttcaatacctatggcatgcacgtgggtcccnccaggctccgaggcaaggggctgggagtgggtggctaggttattgggttgatgggaactatgaattacatgcagngtccgtgaaggccatcacatctcagagacaatccagataatttgatcttanagatagaacagcctgagtacggtcgagacacggctagtagtattacgtgtggacagtaggaaagcgaagggngtagtgggtagagggtggtacg

SEQ ID NO: 6210 - DNA, 505 bp, Homo sapiens
  misc_feature: GYAE6OF02G568K.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactgggtccgccaggctccaggcaaggggctgggagtgggtggcagttatttggttgagtggaactatgaatactatgcagagtccgtgaagggccattcaccatctcagagacaattccaggagtaattttgtattcttcagatgaacagcctgagagtcgaggacacgctatgtattactgtgcgtatagaagcgaggaggagtggtcgtaggtggtagg

SEQ ID NO: 6211 - DNA, 546 bp, Homo sapiens
  misc_feature: GYAE6OF02GMJ6Q.24.76.G10.1.454.CMB.1.raw
  modified_base (294)..(294): a, c, t, g, unknown or other
  misc_feature (294)..(294): n is a, c, g, or t
  modified_base (380)..(380): a, c, t, g, unknown or other
  misc_feature (380)..(380): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggagcgtggtccagcctgggaggtccctgagactgtcctgtgcagcgtctggacacatcttcaatacctatggcatgcacgtgggtcccnccaggcctcccgagggcaagggggctgggaggtggggtggctaggtttatttgggtttgatgggaactaatgaatactatgcaagngtccgtggaacgggcctattcaccatctccagagacaattccaggtagtaattttgtattcttacagtatgaacagacctgagtagtcggaacggacacggtctagtgttattacgtgtgacgtagtagaagcgaggacggtagttgggtacgtaggtgggtacgg

SEQ ID NO: 6212 - DNA, 599 bp, Homo sapiens
  misc_feature: GYAE6OF02J1DLL.24.76.G10.1.454.CMB.1.raw
  modified_base (315)..(315): a, c, t, g, unknown or other
  misc_feature (315)..(315): n is a, c, g, or t
  modified_base (550)..(550): a, c, t, g, unknown or other
  misc_feature (550)..(550): n is a, c, g, or t
tcagactactatgtcacgaccggtgctcgatttagtcactcatacaggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctggggagtccctgagactgtcctgtgcagcgtctggacacatcttcaatacctatggcatgcactgggtccgcaggctccaggcaaggggctggngtgggtgcgagttattggttgatgggaactagtgaatacgtatgctagacgtccgtaggaacgggcctattacaccgtatccgtaccgagacgaactaacttaccgaggtacgtaattttgtaacttcttacagtaactagaacgtacgtacctagaagtacggtacggtaaggaaccgaccgggtacttagttacgttaatttacgttggtacggcgttaaggtagtaaacggnggtaagggtaagggtaggttaggggttacggtagggttcggggtaacgg

SEQ ID NO: 6213 - DNA, 669 bp, Homo sapiens
  misc_feature: GYAE6OF02HJIQ5.24.76.G10.1.454.CMB.1.raw
tcagactactatgtcacgaccggtgctcgatttagtcactcatacaggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggagtccctgagactgtcctgtgcagcgtctggacacatcttcaatacctatgcatgcactgggtcccgccgaggcctccgaggcgaaggggctgggagtgggtgctaggtttagtttggtttgattggaaactaagtgaatactatgacagacgtccggtagaacggggccgtattccgaacccatcccgtaccgaaggaacgtaaccaaacgtttcccgaagggtacgttaaagttttttgtaactttcctttacgaagtaagtacgtaaacgcggtacccttagggaacggtaacggttaccgggaagggaaacccgtaccgggtacttagttacggtttaatttaacccggttggtacggtaccggtaagttaacgggaaaacggccgtaagggggaggttaacggttaggggttttaaccgggagggttagggggtaacgg

SEQ ID NO: 6214 - DNA, 339 bp, Homo sapiens
  misc_feature: GYAE6OF02HJS2J.24.76.G10.1.454.CMB.1.raw
  modified_base (327)..(327): a, c, t, g, unknown or other
  misc_feature (327)..(327): n is a, c, g, or t
  modified_base (333)..(339): a, c, t, g, unknown or other
  misc_feature (333)..(339): n is a, c, g, or t
tcagactactatgtcacgaccggtgctcgatttagtcactcatacagggtgtacacctgtggttctcggggctgccctttggttttggagatggttttctcgatgggggctgggaggcctttgttggagaccttgcacttgtactccttgccgttcagccagtcctggtgcacgacggtgaggacgctgaccacacggaacgtgctgttgaactgctcctcccgtggctttgtcttggcattatgcacctccgagagcacaggcggccctgggctgcctggtcaaggactacttccacatagtagtctgagcgggctggcaagggcncatagnnnnnnn

SEQ ID NO: 6215 - DNA, 519 bp, Homo sapiens
  misc_feature: GYAE6OF02HV51I.24.76.G10.1.454.CMB.1.raw
  modified_base (292)..(292): a, c, t, g, unknown or other
  misc_feature (292)..(292): n is a, c, g, or t
  modified_base (465)..(465): a, c, t, g, unknown or other
  misc_feature (465)..(465): n is a, c, g, or t
  modified_base (509)..(509): a, c, t, g, unknown or other
  misc_feature (509)..(509): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggagtccctgagactgtcctgtgcagcgtctggacacatcttcaatacctatggcatgcactgggtccnccaggctccaggcaaggggctggagtgggtgctagttagttggttgatgggaactaatgaatactatgcagacgtccggtagaagggcctattcaccatctcagagactaattccgaaggataattttgtatcttcagtatagaacagctaggagagtcgaggacacggctangttattactggtgacgatagaagcgagggaggtatgggttacgnggtgggtacg

SEQ ID NO: 6216 - DNA, 686 bp, Homo sapiens
  misc_feature: GYAE6OF02G6RN2.24.76.G10.1.454.CMB.1.raw
  modified_base (301)..(301): a, c, t, g, unknown or other
  misc_feature (301)..(301): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctggggacggtccctgagactgtcctgtgcagcgtctggacacatcttacaattacctatggcatgcacgtcgggtcccnccgagggcctccgacgggccgaagggggctagggaggtggggtggcgtagtttagttttgggttgagttagggaaacttaagttaggaaactttacgtagtggactaggaacggttcccggtaggaacgggccgtagttacccgactacgtaccgtaccgaagacgtaacgtaacttaccgaagggtaagttaagtttttagtactttacgttacgaagtacgttacgaaacgtacgtaccgtaggaagtacggtaccggaacggtaaccgaacgggtcttacgtacgtttagttaccgttacggttacgaaccggtaagtaagggtaaacggcggtaacgggtaacggtaggttacggggttacgggtagggtaggggtaacgg

SEQ ID NO: 6217 - DNA, 563 bp, Homo sapiens
  misc_feature: GYAE6OF02IKYC4.24.76.G10.1.454.CMB.1.raw
  modified_base (296)..(296): a, c, t, g, unknown or other
  misc_feature (296)..(296): n is a, c, g, or t
  modified_base (442)..(442): a, c, t, g, unknown or other
  misc_feature (442)..(442): n is a, c, g, or t
  modified_base (456)..(456): a, c, t, g, unknown or other
  misc_feature (456)..(456): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtgggtccagccgtgggaggtccctgagactgtcctgtgcagcgtctggacacatcttcaatacctatggcatgcacgtgggccncagctccgaggcaaggggctgggagtggggtgctagtttagtttgggttgagtggtaaactaagtgaaatctatggctagagtccgtaggaagggcctaattcactatcgtcaagagacaattccgaaggataatttgtatcttanaagtatacgaaacngtcctagacgtagtcgaaggaacctaggtactaagttcgtacgttactaggtcacgtaagtagaaaacggcgtaacggagggtatcgggtttacgaggtgggtaacg

SEQ ID NO: 6218 - DNA, 588 bp, Homo sapiens
  misc_feature: GYAE6OF02G78SL.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggaggtccctgagactgtcctgtgcagcgtctggacacatcttacaatacctatggcatgcacgtcgggtcccgccgaggcctccgaggccaaggggctggggagtgggtggctagtttagtttgggttgatggaactaagtgaaatactatgcaagtagtccgtggaacgggcctaattccaacctatcctacccaagacgaactaagttcccgaagggtaacgtaattttagtacttcgttacaagtatacgaaacagccctaggacgagtcggaacggaccgacggtctagttagttagttaccgtggttgaccgtagtaaggaaagcggaaggtaggagttgggtacgaggtgggtacgg

SEQ ID NO: 6219 - DNA, 551 bp, Homo sapiens
  misc_feature: GYAE6OF02FN5XF.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggagtccctgagactgtcctgtgcagcgtctggacacatcttcaatacctatggcatgcactgggtcccgccaggcctccgaggcgaaggggctgggagtgggtgcagtttattggttgatggaactaatgaatactatgcagtgtccgtggaacgggccattcgacctatctccagacgtacaaacttcccgaaggtagttaattttgtaattccttagaagtatagaaacagacctagacgtagtcgaacggacgacggtcgtaatgttattacgtggttgactagtagaaagcgaaggtaggagttagggtcgaggtgggtacgg

SEQ ID NO: 6220 - DNA, 526 bp, Homo sapiens
  misc_feature: GYAE6OF02G8Z2E.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggaggtccctgagactgtcctgtgcagcgtctggacacatcttcaatacctatggcatgcactgggtcccgccaggctccaggcaaggggctggagtgggtgctagttagttggttgagtggaactaatgaatactatgacagacgtccgtggaacgggccgtatcaccatctccagagacaattaccgaggagtaatttgtatcttcagatagaacacgtcctagagtacgtacgaggacgacgtctatgttattacgtgtgcgagtagaaagcgaggaggagtggtacgaggtggtacg

SEQ ID NO: 6221 - DNA, 654 bp, Homo sapiens
  misc_feature: GYAE6OF02F14O8.24.76.G10.1.454.CMB.1.raw
  modified_base (347)..(347): a, c, t, g, unknown or other
  misc_feature (347)..(347): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggagcgtggtccagcctgggaggtccctgagactgtcctgtgcagcgtctggacacatcttcaatacctatggcatgccacgtgggtcccgccgaggcctccaggccaaggggctgggagtgggtggctagttatttgggttnatgggaactaatgaaatactatgacaggagttccgtaggaaacgggtcccgaatttccaacctactcctaccgagaacgaactaaacttaccgaagggtagttaagttttgtaacttcgttacgtagtaacttaggaaacctaggacccgtaggaacggtaaggttacggaaggaacccgtaacggtccgttaagttaggtttacttaacgttacggttcggaccggttaattaacgggaaacggtaccggtaaggggtaacggtaaccggtttagggtttaaccgggtagggttacggggtaacgg

SEQ ID NO: 6222 - DNA, 760 bp, Homo sapiens
  misc_feature: GYAE6OF02JRSXF.24.76.G10.1.454.CMB.1.raw
tcagactactatgtcacgaccggtgctcgatttagtcactcatacagggggggagaggagcccagcactagaaggtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcggtggtccagccgtgggagtccctgagactgtcctgtgcagcgtctggacacatcttcaatacctatggcatgcacgtcgggcccgccaggcctcccgagggccgaaggggctgggaggtggggtggctaggtttagtttgggttgagttagggtaaaccttaagtagtaaattactagtggactaaggtacgttaccggtaggaacggggtccctaagtttacccaacccgtaagttcccgtacccgaaaggtaaccgtaaacctaacgtttacccgaaaggggttaacgtttaaacgttttttaggtaactttaccgtttaaccgaagttaacgtacgggaaacctacgggtacccgttaagggtaacggtaacgggttaccggaacgggtaacccggtaacggtaccgttaaggttacggttaacgttttaaccggtcgggttaacggtaccggttaaagttaacgggtaaaaacggtccggtaaaaggggttaacgggtacggtttacgggggttttaacgggaaggggttacggggtaaccgg

SEQ ID NO: 6223 - DNA, 699 bp, Homo sapiens
  misc_feature: GYAE6OF02H3MEJ.24.76.G10.1.454.CMB.1.raw
  modified_base (352)..(352): a, c, t, g, unknown or other
  misc_feature (352)..(352): n is a, c, g, or t
tcagactactatgtcacgaccggtgctcgatttagtcactcatacagggggggagaggagcccagcactagaagtcggcggtgtttccattcggtgatacacgcactgaacacagaggactcaccatggagtttggcctgactgggttttcctcgttgctcttttaagaggtgtccagtgtccaggtgcagctgggtggagtcgtggggggaggcgtgggtccagccgtgggagtccctggaggctgtcctggtgcagcgtctggactacattccttacaattaccctagtcggacattgcacgtcgggtcccgcagggcctccgagggtcgaaggggctgggaggtggggnggcgtaggtttagtttgggttgacgtaggaacttaagtggaacttactagtgactagacgttccggtaggaacgggtccgtaagttccgaccgtactcccgtacgaacggaacgaaccgtaacttccgaagggtaattaagttttagtaacttccgttacgtaagtacgtaacgaacgtacggtaccgttaggacgtacgggtacggaacgggtaccggtaaccggtcttaagttacggtttacgtttaaccggtcggttaacggtacggttaagttaacgggaaacggtcggaagggttaacgggtaaggttcggggtttaacggtaggggttagggttaaccggg

SEQ ID NO: 6224 - DNA, 558 bp, Homo sapiens
  misc_feature: GYAE6OF02GDW6N.24.76.G10.1.454.CMB.1.raw
  modified_base (455)..(455): a, c, t, g, unknown or other
  misc_feature (455)..(455): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctgaacacatcttcaatacctatggcatgcacgtgggtcccgccaggcctccgaggcaaggggctggagtggggtgctagtttagtttgggtttgattggaaactagtgtaaatctatgacagagtccgtagaacgggcctattcgactatctccagagacaattaccaggtagtaattttgattcttacagtactagaacngtacctagagacgtcgaaggaccacggtactagtagttatactaggtcgtacgtagtaagaagacgaaggtagggtagttagggttaggacgggtgggtaacg

SEQ ID NO: 6225 - DNA, 731 bp, Homo sapiens
  misc_feature: GYAE6OF02HX0SZ.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggagtcccctgagactgtccgtgtgcagcgtctggacacatcttcaatacctatgcatgcacgtgggtccgccaggcctccgagggcaaggggctagggaggtggggtgacgtaggtttagtttgggtttagaattagggaaacttaaagtgtaaattactaagtcgactaaggacgttccggtaggaacggggtccctaagtttcccgaaaccgtatacccgttaccaacggtaaacggaacctaaacttcccgaagggtaaacgttaaagtttttttcgtacttaccgtttaacgaaggtaattacggaaacctacggtaccgttagggaaaggtaacggttacgggaaacgggtaaccggtaaccgggtaactttaaggttacgtttaacgttttaccggtttacgggacggttacggtaacgttaaggaaaacgggtaccggtaagggggaacggttaaacggtttaggggggtttaaccgtagggggttacgggggtaacgg

SEQ ID NO: 6226 - DNA, 527 bp, Homo sapiens
  misc_feature: GYAE6OF02IIR0R.24.76.G10.1.454.CMB.1.raw
  modified_base (293)..(293): a, c, t, g, unknown or other
  misc_feature (293)..(293): n is a, c, g, or t
  modified_base (401)..(401): a, c, t, g, unknown or other
  misc_feature (401)..(401): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggagcgtggtccagcctgggaggtccctgagactgtcctgtgcagcgtctggacacatcttcaatacctatggcatgcactgggtccnccaggctccaggcaaggggctggagtggggtggctagttatttggttgagtggaactaatgaatactatgacagacgtccgtggaagggcgtattcaccatctcaganacaatccgaggataagttttgtaattcttacagtatagtaaacacgctagacgtaggcgagacaggctatgtattagtgtgcgtatagaagcgagggaggtagtagggttacgagggtagggtacg

SEQ ID NO: 6227 - DNA, 648 bp, Homo sapiens
  misc_feature: GYAE6OF02ILWKG.24.76.G10.1.454.CMB.1.raw
  modified_base (408)..(408): a, c, t, g, unknown or other
  misc_feature (408)..(408): n is a, c, g, or t
  modified_base (517)..(517): a, c, t, g, unknown or other
  misc_feature (517)..(517): n is a, c, g, or t
tcagactactatgtcacgaccggtgctcgatttagtcactcatacagggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctggggaggtccctgagactgtcctgtgcagcgtctggacacatcttacaatacctatggactatcgacacgtggggtcccgccgaggtctcccgaggcgaacgggggctaggggacgggttgggggtgacgttaggtttagtttttcgggttagagttaggaaactttaagtcgaaattacttangactagacgttaccgtaggaaacggggcctagttacacctaatcctaccgagtacgaactaacttaccgaggtaacgttaattttagtacttcttacgagtatagaacncgtactagacgaggtacgaaggaccacggtacttattacggttacttacgttggtgtaacggtaacgtaaggaaacggcggaaggggacggttaaggttacggggttacgggttagggtacggggtaacgg

SEQ ID NO: 6228 - DNA, 551 bp, Homo sapiens
  misc_feature: GYAE6OF02IE1UF.24.76.G10.1.454.CMB.1.raw
  modified_base (296)..(296): a, c, t, g, unknown or other
  misc_feature (296)..(296): n is a, c, g, or t
  modified_base (465)..(465): a, c, t, g, unknown or other
  misc_feature (465)..(465): n is a, c, g, or t
  modified_base (524)..(524): a, c, t, g, unknown or other
  misc_feature (524)..(524): n is a, c, g, or t
tcagactactatgtcacgaccggtgctcgatttagtcactcatacagggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactgggtcccnccaggcctccgaggcgaagggggctgggagtggggtggctagttatttggttgagtagggaactaatgaaatactatgacagagtccgtaggaacgggtccgtattcaccatcctaccagacgtaacaattaccgaggtagtaattttgtattcttacagtatagaacngtaccgtgagagtacggaggacgacggacttagtgttattacgtgtgacgatagaacgngaggagtagtggtacggtaggtggacg

SEQ ID NO: 6229 - DNA, 614 bp, Homo sapiens
  misc_feature: GYAE6OF02I47NE.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctgggtggagtctgggggaggcgtggtccagcctgggaggtccctgagactgtcctgtgcagcgtctggacacatcttcaatacctatggcatgcactgggtcccgccaggctccgaggcaagggggctgggaggtgggtggctagttattttggttgagtaggaactaagtgtaaattacgtatgacaggtacgtccggtaggaacggggacctatttaccgacctactcctaccagacgaactaagttcccgaaggtaacgttaagttttacgttacttcttacgagtactacggaactacggtacttagaggtacggtacggaagggaccacggacttaagtcgttattacgtggtagtccgtaagtagaaacggtcgaaggggtaggtacggttgggttacgggtaaggttgggtaacgg

SEQ ID NO: 6230 - DNA, 570 bp, Homo sapiens
  misc_feature: GYAE6OF02FS8II.24.76.G10.1.454.CMB.1.raw
  modified_base (457)..(457): a, c, t, g, unknown or other
  misc_feature (457)..(457): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtggggggagcgtggtccagccgtgggaggtccctgagactgtcctgtgcagcgtctggacacatcttcaatacctatggcatgcacgtgggtcccgccgaggcctccgaggcgaaagggggctgggaggtgggtggctaggtttagtttggtttgatggaaacttagtgtaatactatggacaggtacgtccggtagaacggggcctagttcaccatctccagagaactaatccgaggaactaattttgattcttnaagtatacgaacagacctgacgtaggtacgagggacacggtctatcgttattaccgtggtcacgtagtaggaagtcgaagggtcgtaggttagggtacggtagggtggtacgg

SEQ ID NO: 6231 - DNA, 619 bp, Homo sapiens
  misc_feature: GYAE6OF02G496U.24.76.G10.1.454.CMB.1.raw
  modified_base (297)..(297): a, c, t, g, unknown or other
  misc_feature (297)..(297): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggagcgtggtccagccgtgggagtccctgagactgtcctgtgcagcgtctggacacatcttcaatcctatggcatgcacgtcggggtcccnccgaggcctaccgagggcgaagggggctggggagtggggtgctaggtttagttttgggttgagttggaactaagtgaatacgtatgactaggtacgtccggtaggaacgggtcctagttccacctatccgtaccaggacgaactaacgttaccgaaggtagttaagttttcgattccttacagtatagaaccagtaccgtaggacgtaggtacggaggaaccgacggtacttagtggttacgttacggtggttcggaggtaagtacggaaacgtcggaagggtacgggtaggttacggggttacgggtagggtgggtaacgg

SEQ ID NO: 6232 - DNA, 527 bp, Homo sapiens
  misc_feature: GYAE6OF02FMF1I.24.76.G10.1.454.CMB.1.raw
  modified_base (381)..(381): a, c, t, g, unknown or other
  misc_feature (381)..(381): n is a, c, g, or t
  modified_base (400)..(400): a, c, t, g, unknown or other
  misc_feature (400)..(400): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctggggggaggcgtggtccagcctgggaggtccctgagactgtcctgtgcagcgtctggacacatcttcaatacctatggcatgcactgggtcccgccaggctccaggcgaaggggctgggagtggggtggctagtttatttgggttgagtggaactaatgaatactatgcagagtccggngaacgggcattcaccatcncagagacatccagagtaatttgtattcttcagtatagaacagctagagagtcgagacacggtctagtgtattacgtgtgacgtagtagaagcgaagggacggtagttgggtacggtaggtgggtacg

SEQ ID NO: 6233 - DNA, 596 bp, Homo sapiens
  misc_feature: GYAE6OF02JQKX4.24.76.G10.1.454.CMB.1.raw
  modified_base (264)..(264): a, c, t, g, unknown or other
  misc_feature (264)..(264): n is a, c, g, or t
  modified_base (300)..(300): a, c, t, g, unknown or other
  misc_feature (300)..(300): n is a, c, g, or t
  modified_base (331)..(331): a, c, t, g, unknown or other
  misc_feature (331)..(331): n is a, c, g, or t
  modified_base (469)..(469): a, c, t, g, unknown or other
  misc_feature (469)..(469): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggagcgtggtccagccgtgggacgtccctgagactgtcctgtgcagcgtctggacacntctcaacttacctagtggcatcgcacgtcgggtccncaggcctccgaggcgaagggctggagtgggngctagttgttggttagagtggtaactaatgaacttactagtgactagtacgtcgtaggaacgggctagttcaccgtatcctcgaagagaactacgttaccgagtaacttatttagtatcgttagaagtatacgtaacngtaccctaggtaatacggtacgaacgacgtaccggattagtagttacgttacgtggtacgacggtaagtaacggaaacggtagtaacgggtaaggtaacgttacgggtaggtacgggtaggggtacg

SEQ ID NO: 6234 - DNA, 663 bp, Homo sapiens
  misc_feature: GYAE6OF02HD3Z5.24.76.G10.1.454.CMB.1.raw
  modified_base (439)..(439): a, c, t, g, unknown or other
  misc_feature (439)..(439): n is a, c, g, or t
  modified_base (547)..(547): a, c, t, g, unknown or other
  misc_feature (547)..(547): n is a, c, g, or t
  modified_base (601)..(601): a, c, t, g, unknown or other
  misc_feature (601)..(601): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaacttgggttttcctcggttgcttacgtttttaaggaggttgtcctagtgtcgaggtgcagctggtggagtcgtggggggagcggtggtaccagccgtgggacggtccctgagactcgtcctgtcgaccaggtcgtcgtaggaacacattccttacaaattacctagtcggacagttcgcacggttcgggccccgacacggtcctaccgaaggcgaagggggtctggggacgttggggacgtataaggttttgtttagggttcgaagttggaaaacttagtaggtaaactttacgttagngacgtaaggtacgtccgggtaggaaacgggccctaattaccgaacctagtccgtacaaggacgaactacgtaccaaggtaagttaactttgtactctacgaagtacanaaacgacgtctagaagtacggtacgacggtacaacgtcttagtacgtaattacnggtaacgcgttaagtaacggaaaggtcgaagggtagtaggttcggtaagagggtacggtacg

SEQ ID NO: 6235 - DNA, 588 bp, Homo sapiens
  misc_feature: GYAE6OF02H3ZDM.24.76.G10.1.454.CMB.1.raw
  modified_base (301)..(301): a, c, t, g, unknown or other
  misc_feature (301)..(301): n is a, c, g, or t
  modified_base (417)..(417): a, c, t, g, unknown or other
  misc_feature (417)..(417): n is a, c, g, or t
  modified_base (575)..(575): a, c, t, g, unknown or other
  misc_feature (575)..(575): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggggcagctggtggagtcgtggggggcggcgtggtccaaccgtggggacggtccctgacgtactctcctgtgccggcctccgattcacttcaatacttatggcatgcacgtgggtccnccgaggcctccgagggccaagggggctgggaggtggggtggccgcttacttcttagtttgagtgggaaattaatcaaattatatgcagcctccgtagaagggcccgttacaacctntcctaccgagacgactaaattccaaactaactacttcttgtttcctagtacaattgactagctgcatgtagagactacggcttgtctagttactgtacgacgtaaagtccgttccccgtcctttccgtaatagttacgttggggtcccgaccccttangtacggtagtcgg

SEQ ID NO: 6236 - DNA, 794 bp, Homo sapiens
  misc_feature: GYAE6OF02IW142.24.76.G10.1.454.CMB.1.raw
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctctttaagaggtgtccagtgtcaggtgcagctggtggagtctgggggagcgtggtccagcctgggagtccctggagactgtcctgtgcagcgtctggacactatctacaataccctatcggcatcgctaccgtcgggtcccnccgaggcctccgagggcaagggggctgggaggtgggnggactagtttagtttgggttagagttgggaaacttaagtgtaaattactaatggactaaggtacgtccggtaggaaacggggtcctaatttcccgaaaccgtacgttacccgtacccgaaggtaacgtaaaccgtaaacgtttacccggaaagggttaaacgttaaagtttttttacgtaacgttttacctttaccgtaaaggtaacgtttaacggaaaacccgtaaacggttcccggttaaacgggtaacgttaaaccggggttaccggggaaacgggttaaaccccggtaaccgggttaaccgtttaaacgggtttacggtttaacgttttaacggttacgggttccgggtaaaccggttaaaggttaaacgggtaaaacccggagggttaaacggggtaacggggtaacggtttacgggggtttaaccggtaaggggggttcgggtaacgggg

SEQ ID NO: 6237 - DNA, 701 bp, Homo sapiens
  misc_feature: GYAE6OF02HTN8U.24.76.G10.1.454.CMB.1.raw
  modified_base (300)..(300): a, c, t, g, unknown or other
  misc_feature (300)..(300): n is a, c, g, or t
  modified_base (335)..(335): a, c, t, g, unknown or other
  misc_feature (335)..(335): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggagtccctgagactgtcctgtgcagcgtctggacacatcttacaattacctagtggcatcgcacgtgggtcccncgaggcctccgaggcaaggggctagggagtggggnggctaggtttagtttggttgagttggaaacttaagtggtaaatttacgtagttcggacgaaggtacggttcccgggtaggaaacggggtccctaatttaccgaacccgtaattcccgtaccgaaggaacgaacctaaacgttacccgaaagggttaacgttaaagtttttggtaactttactttacgaagtatacggaacgtacggtaccgttaggaacgtaacggtacggaacgggtaaccgtacgggtacttaagttacggtttacgttacgttcgggtacggtaccggttaagtaacggaaacggtcggtaaggggtaacggttacggttacggggtttacggtacggggttaggggtaccgg

SEQ ID NO: 6238 - DNA, 717 bp, Homo sapiens
  misc_feature: GYAE6OF02ILEM9.24.76.G10.1.454.CMB.1.raw
  modified_base (295)..(295): a, c, t, g, unknown or other
  misc_feature (295)..(295): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggagtccctgagactgtcctgtgcagcgtctggacacatcttcaatacctatggcatgcacgtgggtcccnccaggctccgaggcgaaggggctgggaggtgggtcggactaggtttagttttgggtttcgagtagggtaaacttaagtaggtaattaacgtaatggaccaggtaacggtccggtaggaaacggggtcccgtaagtttccgaacccttaactcccgttaccaaacggtaacgaaccgtaaacgtttacccgaaagggttaacgttaagtttttaggttaacttaccgtttacgtaagtaacttacggaaaccgtaaggtacccgttagggtaacgaacggttaacggaacgggtaaccgtaacggtaccgttaagttacggttaacgtttacgttcgggtacgtaccggtaagttaacgggaaaacggtacggtaaggggtaacgggtagtttacggggtacggttagggtacggggtaacgg

SEQ ID NO: 6239 - DNA, 718 bp, Homo sapiens
  misc_feature: GYAE6OF02GSZ2H.24.76.G10.1.454.CMB.1.raw
  modified_base (275)..(275): a, c, t, g, unknown or other
  misc_feature (275)..(275): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccaggccgtggggacggtccctgagactgtcctgtgcagcgtctggacacttttttancttcaatacctatggacatgcacgtcgggtcccgccgacggcctccgaggacgaagggggcgtgggaggtggggtggcgtaggtttagttttggttgagtaggtaactaagtagtaatacgtatgacagtacgtccggtaggaacgggtcctagttccacctacttcctaccgagaacgaactaacgttaccgaaggtaagttaattttaggtactttctttacgaagtaacttacggaaacctacggtacccgttaggaacggtaacgggtaccgggaacgggtaacccggtaaccgggtaaccgttaagttaccggtttaacgttttaccggtacgggtacggttaaccggtaagttaacgggaaaacggtacgggtaacgggggtacgggttaaccgggtttacgggggttaccgggtaagggggttacggggtaaccgg

SEQ ID NO: 6240 - DNA, 532 bp, Homo sapiens
  misc_feature: GYAE6OF02GLT50.24.76.G10.1.454.CMB.1.raw
  modified_base (477)..(477): a, c, t, g, unknown or other
  misc_feature (477)..(477): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggtttttcctcgttgctcttttaagaggtgtccagtgtcaggtgcagctggtggagtctgggggagcgtggtccagcctgggagtccctgagactgtcctgtgcagcgtctggacacatcttcaatacctatggcatgcactgggtcccgccaggctccgaggcaaggggctgggagtgggtggctagttatttggtttgagtggaactaatgaaatactatgacagacgtccgtaggaacgggtccattcacctatctaccagacgaacaattccgaaggtataattttgattcttcagtatagaacacgcctgagtagtcgaagacacggntagtgtattactgtgacgtagtagaagcgaggaggtagtgggtcgaggtgggacg

SEQ ID NO: 6241 - DNA, 830 bp, Homo sapiens
  misc_feature: GYAE6OF02H88GY.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtgggtccagccgtggggacggtcccctggacgtactgtcctggtgcgagccgtctggacacatcttcaatacctatggcatcgcacgttgggcccgcaggcctccgaggccgaagggggctggggtaggtgggggtggcttaaggtttagttttgggtttgagttacgggtaaactttaagtaggtaaaattacgttagtacggcgtaaggtacggttacccgggtaggggtaaaaccgggggtccccgtaacgttttaccgaacccgttaacgtttaccccgttacccgaaaggtaaccggtaaacctaaaccggtttaaccccggtaaagggttaaacggtttaaacgtttttttacggtttaactttaccgtttaacgtaacggtaagttaaccggtaaacgtaaccggtacccgttaggtaaacggttaccgggttacgggaaacccgggtaaaccggtaaccgggtaaccgtttaagttacggtttaacgtttttaccggttaggttacggtaacggttaacggttaacgggtaaaacggtaccgggtaaggggttaacgggttaacgggtttacgggggtttacggttacgggggttagggttaaccggg

SEQ ID NO: 6242 - DNA, 674 bp, Homo sapiens
  misc_feature: GYAE6OF02G1KKO.24.76.G10.1.454.CMB.1.raw
  modified_base (350)..(350): a, c, t, g, unknown or other
  misc_feature (350)..(350): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggagtccctgagactgtcctgtgcagcgtctggacacatcttacaatacctatggcatgcacgtggtcccgccgaggcctccgaggcaaggggctagggagtggggtgcgtagtttatttgggttnagttagggaaacttagtgtaaatactagtacgcaagtacgtccggtaggaacgggccgtactccgaaccattccgtaccgaacggaacgtaactaaacgtttacccgaagggtaagtttaaacgtttttaggtaactttaccgttacgtaacgtacgtaacgaaacgtaaccgtacccgtttaggaacggtacggttaaccggaacgggaaccgtacggtaaccttagtaacgttactttaccgtaggttccggagtaacgttaacgaaacggtcgtaagggtacggttaacggttcgggtttaacgggagggttgggtaacgg

SEQ ID NO: 6243 - DNA, 680 bp, Homo sapiens
  misc_feature: GYAE6OF02H7JDH.24.76.G10.1.454.CMB.1.raw
  modified_base (259)..(259): a, c, t, g, unknown or other
  misc_feature (259)..(259): n is a, c, g, or t
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccaggccgtggggaggtcccctgagactgtcctgtgcagcgtntggacacatctacaatacctatggcatgctacgtgggtcccncaggcctccgaggcaaggggctgggagtggggngctagtttagttggttagagtggtaaactagtgtaatacgtagtcgctaagtacgtccggtaggaacggggtcctaagtttaccaccgtacgtccttaccgaaggtaacgtaactaacgttaccgaagggtaagttaagtttttacgttaacttacgtttacgaacgttaactacggtaaacgtacggtaccgttagaacggtacggtaacgggaacggtaaccgaacggtacgttaagttacgttaacgtttaccgttgggtaggtaccgttaagtaaggtaaaacgtccggaaagggtacgggtaacggtttacggggttacgggtaacgggttggggtaaccg

SEQ ID NO: 6244 - DNA, 646 bp, Homo sapiens
  misc_feature: GYAE6OF02JTWKR.24.76.G10.1.454.CMB.1.raw
  modified_base (571)..(571): a, c, t, g, unknown or other
  misc_feature (571)..(571): n is a, c, g, or t
tcagactactatgtcacgaccggtgctcgatttagtcactcatacaggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagccgtgggacgtccctgagctgtcctggtgcagcgtctggacacatccttacaatacctatggctagtcgcacgtgggtcccgccgaggcctaccgaggcgaaggggcctgggaggttggggtcggctagggttttagtttgggttacgagtaggtaaacttaagtcgtaaatctaagtgactaggtacgttccgggtagaaacggggtcctaattacccgaacctatcccgtaccgacggtaacgtactaaacgttcccgaaaggtaacgtttagtttacgttaacttaccgttacgaaggtactacggaacgtaacgtccgtagaggtacgtacgggacgtacgaccgtntagtacttagttacgtcggtgtacgtagacgtaacgtacggaaggtcggtaagttcgggtacgtaggtcggtagg

SEQ ID NO: 6245 - DNA, 777 bp, Homo sapiens
  misc_feature: GYAE6OF02IYXQU.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtggggggaggcgtggtccaggccgtgggacggtccctgagactgtcctgtgcagtcgtctggacactatcttcaatacctagtcggcagtcgcacgtcgggtcccgccgaggcctaccgagggcgaagggggcgtgggaggttgggtcggtcgtaaggtttagttttgggtttagagttggaaacttaagtagtaaattacgtagtgacgtaagtacggtccggtagggaaccgggtccgtaacgtttacccaacccgtaactttcccggtaaccgaagggtaaccgtaaaccgttaaacgtttcccggaaaggggttaactttaaacgtttttggttaactttaccgtttaacggaagttacgttaaccgggaaacctacggtacccgttaagggaacggtacgggttaaccggaacgggaaccggtaccggttaccttaaggttaccgtttaacgtttaccggtaggtttaccgggaacgttaagggttaaaccgaaacgggttaccgggtaaggggtaacgggttaacggtttcgggggtttaacgggtaacggggttagggggtaaacccg

SEQ ID NO: 6246 - DNA, 712 bp, Homo sapiens
  misc_feature: GYAE6OF02FI47H.24.76.G10.1.454.CMB.1.raw
  modified_base (295)..(295): a, c, t, g, unknown or other
  misc_feature (295)..(295): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggagcgtggtccagcctgggaggtccctgagactgtcctgtgcagcgtctggacacatcttcaatacctatggcatgcacgtgggtcccncacggctccgaggcaaggggctgggagtggggtcgctaggtttagttttgggtttgacgttagggaaacttaagtggtaaacttacgttaagtgacgtaaggtaacggttcccggtaggaaaaccgggggtccctaagtttacctaacccgagtttaccctacccgtaaggaacgtaaacctaaacgtttcccgaagggtaacgttaacttttttacggtaactttccgtttacgaacgtaacgtttaggaaaccgtacgtacccggttaaggaaggttaacgggttaccgggaacgggtaaccgtaccgggtacttaacgttaggtttaacttaccgttgggttacggacggttaatagggaaaacgtccgaaggggtacggtaaggttgggtttacgggtagggtggggtaaccg

SEQ ID NO: 6247 - DNA, 767 bp, Homo sapiens
  misc_feature: GYAE6OF02GJGF2.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctgggtggagtcgtggggggaggtcgtggtccagccgtgggacggtccctgagactgtcctgtgcagcgtctggaccacattccttacgaaacttaccttagtcgggaccagtcggactaccgttcggggtacccgaccgacgggtcctaccgagggaccggaaaggggggtcctaggggacgggttgggggtcgggtaccgttaaggggtttttagtttttcggggtttagaacggttggggtaaaacctttaagtaggtaaaacttaacgttagtacggacgtaaggtacgggttaccggtagggaaccggggtcctaagttaccccgaacccgtacgttaccgaccgaaggtaaccggtaaactaaccgttaccggaagggtaacgtttaagtttttacggtactttaccgttacgaaagttacgttaacggaaacctccggtaccgtaggtaacgtacggttacgggaaccgggtaccgtacggtattacgttagttacgttcgtaggtacgacgtagtaacggaaggcggaagggtaggttagggttcgggttacgggagggttggggtacg

SEQ ID NO: 6248 - DNA, 560 bp, Homo sapiens
  misc_feature: GYAE6OF02HQYW0.24.76.G10.1.454.CMB.1.raw
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggagcgtggtccagcctgggaggtccctgagactgtcctgtgcagcgtctggacacatcttcaattacctatggcatgcacgtgggtccnccgaggcctccgaggcaaggggctggagtgggtgcagtttnttggtnatggaactagtgaatactatgcagtagtccgtgaacgggcctagtcaccgtatctcagagacaattccgaaggtataatttgtattcttacagtatacgaactacgcctagagtacgtacgaggaccgacggacttagtagtatttacgtagtcggtacgtaattaggaaacgtcgaagggtacggtaagttacggggtttacgtagggtacgggtacg

SEQ ID NO: 6249 - DNA, 675 bp, Homo sapiens
  misc_feature: GYAE6OF02GLYCD.24.76.G10.1.454.CMB.1.raw
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggagcgtggtccagccgtgggacggtcctgagactgtcctgtgcagcgtctggacacntcttacaatacctatggcatgcacgtcgggtcccncgacggcctccgagggcgaaggggctggggaggtggggtgactaggtttagtttgggttagagtacgggaaacttaagtgtaaacttcgtatcggactagacggtccggtaggaaccgggtccgtaattcccgaacctaatccccgtacgaaggacgtaaacctaacttcccggaaaggttactttaaaggttttcgtaactttaccgttaacgaagtacgtaacgaacgtacggtcccgttaaggacggttaacggtacgggaacgggtacctacgggtaacttagttagttaccgtttaacgtgggtcggtaaccgtaaggttaagaacggtggtaaggggtagtaggtttcgggtacggtaggggtggtaacg
